US011751515B2

(12) United States Patent
Von Maltzahn

(10) Patent No.: US 11,751,515 B2
(45) Date of Patent: Sep. 12, 2023

(54) ENDOPHYTE COMPOSITIONS AND METHODS FOR IMPROVEMENT OF PLANT TRAITS IN PLANTS OF AGRONOMIC IMPORTANCE

(71) Applicant: INDIGO AG, INC., Boston, MA (US)

(72) Inventor: Geoffrey Von Maltzahn, Boston, MA (US)

(73) Assignee: Indigo Ag, Inc., Boston, MA (US)

( * ) Notice: Subject to any disclaimer, the term of this patent is extended or adjusted under 35 U.S.C. 154(b) by 473 days.

(21) Appl. No.: 16/064,920

(22) PCT Filed: Dec. 21, 2016

(86) PCT No.: PCT/US2016/068144
§ 371 (c)(1),
(2) Date: Jun. 21, 2018

(87) PCT Pub. No.: WO2017/112827
PCT Pub. Date: Jun. 29, 2017

(65) Prior Publication Data
US 2019/0008158 A1   Jan. 10, 2019

Related U.S. Application Data

(60) Provisional application No. 62/270,539, filed on Dec. 21, 2015.

(51) Int. Cl.
*A01G 7/06* (2006.01)
*A01H 3/00* (2006.01)

(52) U.S. Cl.
CPC .............. *A01G 7/06* (2013.01); *A01H 3/00* (2013.01)

(58) Field of Classification Search
None
See application file for complete search history.

(56) References Cited

U.S. PATENT DOCUMENTS

| | | |
|---|---|---|
| 2,200,532 A | 5/1940 | Bond |
| 4,642,131 A | 2/1987 | Hoitink |
| 4,940,834 A | 7/1990 | Hurley et al. |
| 5,041,290 A | 8/1991 | Gindrat et al. |
| 5,113,619 A | 5/1992 | Leps et al. |
| 5,229,291 A | 7/1993 | Nielsen et al. |
| 5,292,507 A | 3/1994 | Charley |
| 5,300,127 A | 4/1994 | Williams |
| 5,415,672 A | 5/1995 | Fahey et al. |
| 5,730,973 A | 3/1998 | Morales et al. |
| 5,919,447 A | 7/1999 | Marrone et al. |
| 5,989,543 A | 11/1999 | Davide et al. |
| 5,994,117 A | 11/1999 | Bacon et al. |
| 6,072,107 A | 6/2000 | Latch et al. |
| 6,077,505 A | 6/2000 | Parke et al. |
| 6,337,431 B1 | 1/2002 | Tricoli et al. |
| 6,495,133 B1 | 12/2002 | Xue |
| 6,602,500 B1 | 8/2003 | Kharbanda et al. |
| 6,681,186 B1 | 1/2004 | Denisov et al. |
| 6,689,880 B2 | 2/2004 | Chen et al. |
| 6,823,623 B2 | 11/2004 | Minato et al. |
| 7,037,879 B2 | 5/2006 | Imada et al. |
| 7,080,034 B1 | 7/2006 | Reams |
| 7,084,331 B2 | 8/2006 | Isawa et al. |
| 7,335,816 B2 | 2/2008 | Kraus et al. |
| 7,341,868 B2 | 3/2008 | Chopade et al. |
| 7,435,411 B2 | 10/2008 | Park et al. |
| 7,485,451 B2 | 2/2009 | VanderGheynst et al. |
| 7,555,990 B2 | 7/2009 | Beaujot |
| 7,632,985 B2 | 12/2009 | Malven et al. |
| 7,763,420 B2 | 7/2010 | Stritzker et al. |
| 7,906,313 B2 | 3/2011 | Henson et al. |
| 7,977,550 B2 | 7/2011 | West et al. |
| 8,019,694 B2 | 9/2011 | Fell et al. |
| 8,143,045 B2 | 3/2012 | Miasnikov et al. |
| 8,455,198 B2 | 6/2013 | Gao et al. |
| 8,455,395 B2 | 6/2013 | Miller et al. |
| 8,465,963 B2 | 6/2013 | Rolston et al. |
| 8,728,459 B2 | 5/2014 | Isawa et al. |
| 8,975,489 B2 | 3/2015 | Craven |
| 9,049,814 B2 | 6/2015 | Marx et al. |
| 9,113,636 B2 | 8/2015 | von Maltzahn et al. |
| 9,277,751 B2 | 3/2016 | Sword |
| 9,288,995 B2 | 3/2016 | von Maltzahn et al. |
| 9,295,263 B2 | 3/2016 | von Maltzahn et al. |
| 9,364,005 B2 | 6/2016 | Mitter et al. |
| 9,408,394 B2 | 8/2016 | von Maltzahn et al. |
| 9,532,572 B2 | 1/2017 | von Maltzahn et al. |
| 9,532,573 B2 | 1/2017 | Von Maltzahn et al. |
| 9,545,111 B2 | 1/2017 | Sword |

(Continued)

FOREIGN PATENT DOCUMENTS

| | | |
|---|---|---|
| AU | 2015201322 | 4/2015 |
| CA | 1041788 A | 11/1978 |

(Continued)

OTHER PUBLICATIONS

Sulistiyani, et al. (Microbiology Indonesia 8.2 (2014): 4). (Year: 2014).*
GenBank Accession NR_041978, dated Aug. 8, 2011. (Year: 2011).*
GenBank Accession AF394537, dated Jul. 2, 2002. (Year: 2002).*
Yuan et al. (Soil Biology and Biochemistry 89 (2015): 206-209). (Year: 2015).*
PCT Invitation to Pay Additional Fees, PCT Application No. PCT/US2015/068206, dated Apr. 12, 2016, 5 Pages.
PCT International Search Report and Written Opinion, PCT Application No. PCT/US2015/068206, dated Jun. 27, 2016, 20 Pages.
PCT International Search Report and Written Opinion, PCT Application No. PCT/US2016/030292, dated Aug. 12, 2016, 20 Pages.

(Continued)

*Primary Examiner* — Charles Logsdon
(74) *Attorney, Agent, or Firm* — Goodwin Procter LLP

(57) ABSTRACT

Materials and methods for improving plant traits and for providing plant benefits are provided. In some embodiments, the materials, and methods employing the same, can comprise endophytes.

19 Claims, 6 Drawing Sheets

Specification includes a Sequence Listing.

(56) References Cited

U.S. PATENT DOCUMENTS

| | | | |
|---|---|---|---|
| 9,622,485 B2 | 4/2017 | von Maltzahn et al. |
| 9,652,840 B1 | 5/2017 | Shriver et al. |
| 9,687,001 B2 | 6/2017 | Vujanovic et al. |
| 9,756,865 B2 | 9/2017 | Sword |
| 10,058,101 B2 | 8/2018 | von Maltzahn et al. |
| 10,076,120 B2 | 9/2018 | von Maltzahn et al. |
| 10,104,862 B2 | 10/2018 | Vujanovic et al. |
| 10,136,646 B2 | 11/2018 | Von Maltzahn et al. |
| 10,212,912 B2 | 2/2019 | Vujanovic et al. |
| 10,306,890 B2 | 6/2019 | Mitter et al. |
| 10,362,787 B2 | 7/2019 | Mitter et al. |
| 10,499,652 B2 | 12/2019 | von Maltzahn et al. |
| 10,499,653 B2 | 12/2019 | von Maltzahn et al. |
| 10,499,654 B2 | 12/2019 | von Maltzahn et al. |
| 10,640,783 B2 | 5/2020 | Riley |
| 10,645,938 B2 | 5/2020 | Riley |
| 10,667,523 B2 | 6/2020 | Ambrose et al. |
| 10,750,711 B2 | 8/2020 | Djonovic et al. |
| 10,932,469 B2 | 3/2021 | Mitter et al. |
| 11,119,086 B2 | 9/2021 | Mitter et al. |
| 11,151,379 B2 | 10/2021 | Freitag et al. |
| 2001/0032162 A1 | 10/2001 | Alsberg et al. |
| 2002/0059091 A1 | 5/2002 | Hay et al. |
| 2002/0120555 A1 | 8/2002 | Lerner |
| 2002/0142917 A1* | 10/2002 | Triplett .................. A01N 65/44 504/117 |
| 2002/0147670 A1 | 10/2002 | Lange |
| 2003/0050901 A1 | 3/2003 | Jester et al. |
| 2003/0195822 A1 | 10/2003 | Tatge et al. |
| 2003/0236738 A1 | 12/2003 | Lange et al. |
| 2005/0008619 A1 | 1/2005 | Park et al. |
| 2005/0070435 A1 | 3/2005 | Chopade et al. |
| 2005/0072047 A1 | 4/2005 | Conkling et al. |
| 2006/0046246 A1 | 3/2006 | Zeng et al. |
| 2006/0178269 A1* | 8/2006 | Medina-Vega ........ A01N 63/27 504/117 |
| 2006/0185207 A1 | 8/2006 | Mitcheltree |
| 2007/0028318 A1 | 2/2007 | Livore et al. |
| 2007/0055456 A1 | 3/2007 | Raftery et al. |
| 2007/0142226 A1 | 6/2007 | Franco |
| 2007/0292953 A1 | 12/2007 | Mankin et al. |
| 2008/0229441 A1 | 9/2008 | Young et al. |
| 2008/0289060 A1 | 11/2008 | De Beuckeleer et al. |
| 2009/0155214 A1 | 6/2009 | Isawa et al. |
| 2009/0300781 A1 | 12/2009 | Bancroft et al. |
| 2010/0064392 A1 | 3/2010 | Yang et al. |
| 2010/0095396 A1 | 4/2010 | Voeste et al. |
| 2010/0114753 A1 | 5/2010 | Osmanski et al. |
| 2010/0130365 A1 | 5/2010 | Notten et al. |
| 2010/0205690 A1 | 8/2010 | Blasing et al. |
| 2010/0227357 A1 | 9/2010 | Redman et al. |
| 2011/0033436 A1 | 2/2011 | Chen et al. |
| 2011/0182862 A1 | 7/2011 | Green et al. |
| 2011/0195406 A1 | 8/2011 | Sorenson et al. |
| 2012/0108431 A1 | 5/2012 | Williams et al. |
| 2012/0116943 A1 | 5/2012 | Abramson |
| 2012/0131696 A1 | 5/2012 | Aayal et al. |
| 2012/0144533 A1 | 6/2012 | Craven |
| 2012/0149571 A1 | 6/2012 | Kloepper et al. |
| 2012/0178624 A1 | 7/2012 | Kaminskyj et al. |
| 2012/0324599 A1 | 12/2012 | Kerns et al. |
| 2013/0031673 A1 | 1/2013 | Grandlic et al. |
| 2013/0071425 A1 | 3/2013 | Vidal et al. |
| 2013/0079225 A1 | 3/2013 | Smith et al. |
| 2013/0150240 A1 | 6/2013 | Newman et al. |
| 2013/0233501 A1 | 9/2013 | Van Zyl et al. |
| 2014/0020136 A1 | 1/2014 | Van Der Wolf et al. |
| 2014/0109249 A1 | 4/2014 | Turner et al. |
| 2014/0115731 A1 | 4/2014 | Turner et al. |
| 2014/0134629 A1 | 5/2014 | Turner et al. |
| 2014/0147425 A1 | 5/2014 | Henn et al. |
| 2014/0342905 A1 | 11/2014 | Bullis et al. |
| 2015/0020239 A1 | 1/2015 | von Maltzahn et al. |
| 2015/0033420 A1 | 1/2015 | Rodriguez et al. |
| 2015/0126365 A1 | 5/2015 | Sword |
| 2015/0218568 A1 | 8/2015 | Jones et al. |
| 2015/0230478 A1 | 8/2015 | Vujanovic et al. |
| 2015/0242970 A1 | 8/2015 | Avey et al. |
| 2015/0282490 A1 | 10/2015 | Wachendorff-Neumann et al. |
| 2015/0289518 A1 | 10/2015 | Andersch et al. |
| 2015/0296802 A1 | 10/2015 | Wachendorff-Neumann et al. |
| 2015/0296803 A1 | 10/2015 | Andersch et al. |
| 2015/0296804 A1 | 10/2015 | Andersch et al. |
| 2015/0305348 A1 | 10/2015 | Andersch et al. |
| 2015/0320050 A1 | 11/2015 | von Maltzahn et al. |
| 2015/0320051 A1 | 11/2015 | Wachendorff-Neumann et al. |
| 2015/0335029 A1 | 11/2015 | Mitter et al. |
| 2015/0342199 A1 | 12/2015 | Carrion Villanovo et al. |
| 2015/0366217 A1 | 12/2015 | Vujanovic et al. |
| 2015/0368607 A1 | 12/2015 | Arnold et al. |
| 2015/0370935 A1 | 12/2015 | Starr |
| 2015/0373993 A1 | 12/2015 | von Maltzahn et al. |
| 2016/0000091 A1 | 1/2016 | Andersch et al. |
| 2016/0021891 A1 | 1/2016 | von Maltzahn et al. |
| 2016/0150796 A1 | 6/2016 | von Maltzahn et al. |
| 2016/0174570 A1 | 6/2016 | Vujanovic et al. |
| 2016/0192662 A1 | 7/2016 | Sword |
| 2016/0205947 A1 | 7/2016 | Sword |
| 2016/0235074 A1 | 8/2016 | von Maltzahn et al. |
| 2016/0255844 A1 | 9/2016 | Mitter et al. |
| 2016/0260021 A1 | 9/2016 | Marek |
| 2016/0286821 A1 | 10/2016 | Sword |
| 2016/0290918 A1 | 10/2016 | Xu et al. |
| 2016/0316760 A1 | 11/2016 | Ambrose et al. |
| 2016/0316763 A1 | 11/2016 | Sword |
| 2016/0330976 A1 | 11/2016 | Mitter et al. |
| 2016/0338360 A1 | 11/2016 | Mitter et al. |
| 2016/0350855 A1 | 12/2016 | Lerner |
| 2016/0366892 A1 | 12/2016 | Ambrose et al. |
| 2017/0020138 A1 | 1/2017 | Von Maltzahn et al. |
| 2017/0064361 A1 | 3/2017 | Pinca, IV et al. |
| 2017/0161560 A1 | 6/2017 | Itzhaky et al. |
| 2017/0164619 A1 | 6/2017 | von Maltzahn et al. |
| 2017/0164620 A1 | 6/2017 | von Maltzahn et al. |
| 2017/0215358 A1 | 8/2017 | Franco et al. |
| 2017/0223967 A1 | 8/2017 | Mitter et al. |
| 2018/0020677 A1 | 1/2018 | Ambrose et al. |
| 2018/0060771 A1 | 3/2018 | Mangin |
| 2018/0092365 A1 | 4/2018 | Sword |
| 2018/0153174 A1 | 6/2018 | Riley et al. |
| 2018/0177196 A1 | 6/2018 | Sword |
| 2018/0189564 A1 | 7/2018 | Freitag et al. |
| 2018/0213800 A1 | 8/2018 | Djonovic et al. |
| 2018/0249716 A1 | 9/2018 | Riley |
| 2018/0251776 A1 | 9/2018 | Riley |
| 2018/0322426 A1 | 11/2018 | Schmaltz et al. |
| 2019/0130999 A1 | 5/2019 | Oppenheim et al. |
| 2021/0372997 A1 | 12/2021 | Von Maltzahn et al. |

FOREIGN PATENT DOCUMENTS

| | | |
|---|---|---|
| CA | 1229497 A | 11/1987 |
| CA | 2562175 A1 | 4/2008 |
| CA | 2916678 A1 | 12/2014 |
| CA | 2960032 A1 | 3/2015 |
| CA | 2935218 A1 | 7/2015 |
| CA | 2953466 A1 | 12/2015 |
| CA | 2953697 A1 | 12/2015 |
| CN | 1604732 A | 4/2005 |
| CN | 1948459 A | 4/2007 |
| CN | 101311262 A | 11/2008 |
| CN | 101423810 A | 5/2009 |
| CN | 101570738 A | 11/2009 |
| CN | 101693881 A | 4/2010 |
| CN | 102010835 A | 4/2011 |
| CN | 102123596 A | 7/2011 |
| CN | 102168022 A | 8/2011 |
| CN | 102352327 A | 2/2012 |
| CN | 102533601 A | 7/2012 |
| CN | 103642725 A | 3/2014 |
| CN | 103865837 | 6/2014 |
| CN | 104250616 A | 12/2014 |
| CN | 104388356 A | 3/2015 |
| CN | 104560742 A | 4/2015 |

(56) References Cited

FOREIGN PATENT DOCUMENTS

| | | |
|---|---|---|
| CN | 105886428 | 8/2016 |
| CN | 106434493 | 2/2017 |
| EP | 0192342 A2 | 8/1986 |
| EP | 0223662 A1 | 5/1987 |
| EP | 0378000 A2 | 7/1990 |
| EP | 0494802 A1 | 7/1992 |
| EP | 0818135 A1 | 1/1998 |
| EP | 1389767 | 2/2004 |
| EP | 1621632 A1 | 2/2006 |
| EP | 1935245 A1 | 6/2008 |
| EP | 1967057 | 9/2008 |
| EP | 2114118 | 9/2012 |
| EP | 2676536 A1 | 12/2013 |
| EP | 2959779 | 12/2015 |
| EP | 3041338 | 7/2016 |
| EP | 3659414 | 6/2020 |
| JP | 2003300804 A | 10/2003 |
| JP | 2009/072168 A | 4/2009 |
| KR | 20050039979 | 5/2005 |
| KR | 20100114806 A | 10/2010 |
| KR | 101066283 | 9/2011 |
| KR | 101091151 B1 | 12/2011 |
| KR | 20120004958 | 1/2012 |
| KR | 20130023491 A | 3/2013 |
| RU | 2043028 C1 | 9/1995 |
| WO | 1988/009114 | 1/1988 |
| WO | 1994/016076 | 7/1994 |
| WO | 98/35017 | 8/1998 |
| WO | 99/59412 | 11/1999 |
| WO | 2000/029607 A1 | 5/2000 |
| WO | 2001/046774 | 12/2000 |
| WO | 2001/083697 A2 | 11/2001 |
| WO | 2001/083818 A2 | 11/2001 |
| WO | 2002/065836 A2 | 8/2002 |
| WO | 2003/038066 | 5/2003 |
| WO | 2004/046357 A1 | 6/2004 |
| WO | 2005/003328 A1 | 1/2005 |
| WO | 2007/021200 A1 | 2/2007 |
| WO | 2007/107000 A1 | 9/2007 |
| WO | 2008/103422 A2 | 8/2008 |
| WO | 2008/107097 | 9/2008 |
| WO | 2009/012480 A2 | 1/2009 |
| WO | 2009/078710 A1 | 6/2009 |
| WO | 2009/126473 A1 | 10/2009 |
| WO | 2010/109436 A1 | 9/2010 |
| WO | 2010/115156 A2 | 10/2010 |
| WO | 2011/001127 A1 | 1/2011 |
| WO | 2011/011627 A1 | 1/2011 |
| WO | 2011/082455 A1 | 7/2011 |
| WO | 2011/112781 A2 | 9/2011 |
| WO | 2011/117351 A1 | 9/2011 |
| WO | 2012/016140 | 2/2012 |
| WO | 2012/034996 A1 | 3/2012 |
| WO | 2013/016361 A2 | 1/2013 |
| WO | 2013/029112 A1 | 3/2013 |
| WO | 2013/054272 | 4/2013 |
| WO | 2013/090628 A1 | 6/2013 |
| WO | 2013/122473 A1 | 8/2013 |
| WO | 2013/148290 | 10/2013 |
| WO | 2013/177615 A1 | 12/2013 |
| WO | 2013/190082 A1 | 12/2013 |
| WO | 2014/046553 A1 | 3/2014 |
| WO | 2014/079728 | 5/2014 |
| WO | 2014/082950 A1 | 6/2014 |
| WO | 2014/086747 | 6/2014 |
| WO | 2014/086749 | 6/2014 |
| WO | 2014/086750 | 6/2014 |
| WO | 2014/086752 | 6/2014 |
| WO | 2014/086753 | 6/2014 |
| WO | 2014/086756 | 6/2014 |
| WO | 2014/086758 | 6/2014 |
| WO | 2014/086759 | 6/2014 |
| WO | 2014/086764 | 6/2014 |
| WO | 2014/086776 | 6/2014 |
| WO | 2014/121366 A1 | 8/2014 |
| WO | 2014/206953 A1 | 12/2014 |
| WO | 2014/210372 A1 | 12/2014 |
| WO | 2015/035099 A1 | 3/2015 |
| WO | 2015/069938 A1 | 5/2015 |
| WO | 2015/100431 A2 | 7/2015 |
| WO | 2015/100432 A2 | 7/2015 |
| WO | 2015/114552 | 8/2015 |
| WO | 2015/116838 | 8/2015 |
| WO | 2015/192172 A1 | 12/2015 |
| WO | 2015/200852 A2 | 12/2015 |
| WO | 2015/200902 A2 | 12/2015 |
| WO | 2016020371 | 2/2016 |
| WO | 2016/050726 | 4/2016 |
| WO | 2016/057991 A1 | 4/2016 |
| WO | 2016/090212 A1 | 6/2016 |
| WO | 2016/109758 A2 | 7/2016 |
| WO | 2016/179046 A1 | 11/2016 |
| WO | 2016/179047 A1 | 11/2016 |
| WO | 2016/200987 A1 | 12/2016 |
| WO | 2018094027 | 5/2018 |
| WO | 2018/119419 | 6/2018 |
| WO | 2018102733 A1 | 6/2018 |
| WO | 2018160244 A1 | 9/2018 |
| WO | 2018160245 A1 | 9/2018 |
| WO | 2019/046909 | 3/2019 |
| WO | 2019084380 | 5/2019 |
| WO | 2019113468 | 6/2019 |

OTHER PUBLICATIONS

PCT International Preliminary Reporton Patentability, PCT Application No. PCT/US2016/030292, dated Aug. 2, 2017, 23 Pages.

PCT International Search Report and Written Opinion, PCT Application No. PCT/US2016/030293, dated Aug. 11, 2016, 23 Pages.

PCT International Search Report and Written Opinion, PCT Application No. PCT/US2016/036504, dated Nov. 4, 2016, 18 Pages.

PCT International Search Report and Written Opinion, PCT Application No. PCT/US2016/039191, dated Nov. 29, 2016, 20 Pages.

PCT International Search Report and Written Opinion, PCT Application No. PCT/US2016/068144, dated May 18, 2017, 30 Pages.

Djordjevic, D., et al., "Microtiter Plate Assay for Assessment of Listeria monocytogenes Biofilm Formation," Annl Environ Microbiol., 2002, pp. 2950-2958, vol. 68, No. 6.

European Patent Office, Supplementary Partial European Search Report, European Patent Application No. 13874703.5, dated Jun. 21, 2016, 3 Pages.

European Patent Office, Supplementary European Search Report, European Patent Application No. 13874703.5, dated Oct. 21, 2016, 16 Pages.

European Patent Office, Communication Pursuant to Article 94(3) EPC for European Patent Application No. 13874703.5, dated Jan. 5, 2018, 4 Pages.

European Patent Office, Supplementary European Search Report, European Patent Application No. 14860187.5, dated May 24, 2017, 9 Pages.

European Patent Office, Supplementary European Search Report, European Patent Application No. 14874589.6, dated Jul. 11, 2017, 9 Pages.

European Patent Office, Communication Pursuant to Article 94(3) EPC for European Patent Application No. EP 14748326.7, dated Feb. 15, 2018, 7 Pages.

European Patent Office, Examination Report, European Patent Application No. 14748326.7, dated Jul. 19, 2017, 4 Pages.

European Patent Office, Examination Report for European Patent Application No. EP 14777213.1, dated Oct. 20, 2017, 12 Pages.

European Patent Office, Supplementary European Search Report, European Patent Application No. EP 15809264.3, dated Dec. 4, 2017, 16 Pages.

European Patent Office, Communication Pursuant to Article 94(3) EPC for European Patent Application No. 15810847.2, dated Nov. 17, 2017, 17 Pages.

European Patent Office, Supplementary European Search Report, European Patent Application No. EP 15812324.0, dated Nov. 2, 2017, 19 Pages.

(56) References Cited

OTHER PUBLICATIONS

Dunbar, J, et al., "Uncultured Bacterium Clone NT42a2_20488 16S Ribosomal RNA Gene, Partial Sequence," NCBI GenBank Accession No. JQ378705. Submitted Nov. 8, 2012, 2 Pages.
Jalgaonwala, R., et al., "A Review on Microbiol Endophytes from Plants: A Treasure Search for Biologically Active Metabolites," Global Journal of Research on Medicinal Plants & Indigenous Medicine, 2014, pp. 263-277, vol. 3, No. 6.
Phalip, V., et al., "A Method for Screening Diacetyl and Acetoin-Producing Bacteria on Agar Plates," J Basic Microbiol., 1994, pp. 277-280, vol. 34.
Sword, G., et al., "Manipulating Fungal Endophytes for the Protection of Cotton in the Field," Power Point Presentation dated Jan. 7, 2013.
Theis, K. R., et al., "Uncultured Bacterium Clone GM2GI8201A64RC 16S Ribosomal RNA Gene, Partial Sequence," NCBI GenBank Accession No. JX051943, Submitted May 14, 2012, 1 Page.
Trichoderma definition, 2016, 6 Pages, [online] [Retrieved on Sep. 16, 2016,] Retrieved from the Internet <URL: https://en.wikipedia.org/wiki/Trichoderma>.
Wiegand, I., et al., "Agar and Broth Dilution Methods to Determine the Minimal Inhibitory Concentration (MIC) of AntiMicrobiol Substances," Nature Protocols, 2008, pp. 163-175, vol. 3, No. 2.
PCT International Search Report and Written Opinion, PCT Application No. PCT/US2015/038110, dated Dec. 11, 2015, 36 Pages.
Langille, M.G.I. et al., "Predictive functional profiling of microbial communities using 16S rRNA marker; gene sequences," Nature Biotechnology, 2013, vol. 31, No. 9, pp. 814-821.
PCT Invitation to Pay Additional Fees, PCT Application No. PCT/US2017/064351, dated Feb. 9, 2018, 18 Pages.
PCT International Search Report and Written Opinion, PCT Application No. PCT/US2017/064351, dated Apr. 9, 2018, 25 Pages.
PCT Invitation to Pay Additional Fees, PCT Application No. PCT/US2017/064361, dated Mar. 7, 2018, 18 Pages.
European Patent Office, Supplementary European Search Report for European Patent Application No. 15810847.2, dated Feb. 28, 2018, 19 Pages.
European Patent Office, Extended European Search Report, European Patent Application No. EP 15812324.0, dated Feb. 21, 2018, 23 Pages.
European Patent Office, Extended European Search Report, European Patent Application No. EP 15809264.3, dated Mar. 12, 2018, 14 Pages.
PCT International Search Report and Written Opinion for PCT/US2017/064361, dated May 11, 2018, 22 Pages.
PCT International Search Report and Written Opinion, PCT Application No. PCT/US2017/064292, dated May 11, 2018, 20 Pages.
European Patent Office, Extended European Search Report, European Patent Application No. EP 15876324.3, dated Jun. 12, 2018, 9 Pages.
Redman, R. S., et al., "Thermotolerance Generated by Plant/Fungal Symbiosis," Science, Nov. 2002, vol. 298, 1 Page (with 4 pages of supplemental material).
You, Y., et al., "Analysis of Genomic Diversity of Endophytic Fungal Strains Isolated from the Roots of Suaeda japonica and S. maritima for the Restoration of Ecosystems in Buan Salt Marsh," Korean Journal of Microbiology and Biotechnology, 2012, pp. 287-295, vol. 40, No. 4. (with English Abstract).
Invitation to Pay Additional Fees, PCT Application No. PCT/CA2013/000091, dated Mar. 27, 2013, 2 Pages.
International Search Report and Written Opinion for PCT/EP2013/062976, dated Dec. 22, 2014, 9 Pages.
International Search Report and Written Opinion, Application No. PCT/US2014/054160, dated Dec. 9, 2014, 21 Pages.
Invitation to Pay Additional Fees, PCT Application No. PCT/US2014/064411, dated Feb. 5, 2015, 2 Pages.
International Search Report and Written Opinion, International Application No. PCT/US2014/064411, dated Mar. 27, 2015, 15 Pages.
International Search Report and Written Opinion, International Application No. PCT/US2014/072399, dated Jun. 26, 2015, 22 Pages.
Invitation to Pay Additional Fees, PCT Application No. PCT/US2014/072400, dated Apr. 16, 2015, 6 Pages.
International Search Report and Written Opinion, Application No. PCT/US2014/072400, dated Jul. 8, 2015, 38 Pages.
Abarenkov, K., et al., "PlutoF—A Web Based Workbench for Ecological and Taxonomic Research, with an Online Implementation for Fungal ITS Sequences," Evol Bioinform Online, 2010, pp. 189-196, vol. 6.
Li, Q., "Agrobacterium tumefaciens Strain TA-AT-10 16S Ribosomal RNA Gene, Partial Sequence: GenBank: KF673157.1," Submitted Dec. 16, 2013.
Vujanovic, V., et al., "Mycovitality—a new concept of plant biotechnology," Canadian Journal Plant Pathol. 2007, vol. 29, p. 451.
Vujanovic, V., et al., "19th International Conference on *Arabidopsis*. Research Proceedings—ICAR13," Jul. 23-27, 2008, 264 Pages, Montreal, QC, Canada.
Vujanovic, V., et al., "Mycovitality and mycoheterotrophy: where lies dormancy in terrestrial orchid and plants with minute seeds?" Symbiosis, 2007, vol. 44, pp. 93-99.
Vujanovic, V., et al., "Seed endosymbiosis: a vital relationship in providing prenatal care to plants," Can. J. Plant Sci., NRC Research Press, Feb. 6, 2017, pp. 972-981, vol. 97.
Vujanovic, V., et al: "Fungal communities associated with durum wheat production system: A characterization by growth stage, plant organ and preceding crop", Crop Protection, Elsevier Science, GB, vol. 37, Feb. 19, 2012, pp. 26-34.
Waller, F., et al., "The Endophytic Fungus *Piriformospora indica* Reprograms Barley to Salt-Stress Tolerance, Disease Resistance, and Higher Yield," PNAS, 2005, pp. 13386-13391, vol. 102, No. 38.
Wang, B., et al., "Fungal endophytes of native *Gossypium* species in Australia," Mycological Research, 2007, pp. 347-354, vol. 111, No. 3.
Wang, K., et al., "Monitoring in Planta Bacterial Infection at Both Cellular and Whole-Plant Levels Using the Green Fluorescent Protein Variant GFPuv," New Phytol., 2007, pp. 212-223, vol. 174.
Wang, L. et al. Application of Bioorganic Fertilizer Significantly Increased Apple Yields and Shaped Bacterial Community Structure in Orchard Soil.
Wang, Q., et al., "Naive Bayesian Classifier for Rapid Assignment of rRNA Sequences into the New Bacterial Taxonomy," Appl. Environ. Microbiol., 2007, pp. 5261-5267, vol. 73, No. 16.
Waqas, M., et al., "Endophytic Fungi Produce Gibberellins and Indoleacetic Acid and Promotes Host-Plant Growth during Stress," Molecules, 2012, pp. 10754-10773, vol. 17.
Weaver, P.F., et al., "Characterization of Rhodopseudomonas capsulata," Arch Microbiol., 1975, pp. 207-216, vol. 105.
Weindling, R., "Relation of dosage to control of cotton seedling diseases by seed treatment," Plant Disease Reporter, 1943, 27, pp. 68-70.
Welty, R.E., et al., "Influence of Moisture Content, Temperature, and Length of Storage onSeed Germination and Survival of Endophytic Fungi in Seeds of Tall Fescue and Perennial Ryegrass," Phytopathyol., 1987, pp. 893-900, vol. 77, No. 6.
Whelehan, et al., "Microencapsulation using vibrating technology," Journal of Microencapsulation 2011, vol. 28(8), pp. 669-688.
White, J. F., et al., "A Proposed Mechanism for Nitrogen Acquisition by Grass Seedlings Through Oxidation of Symbiotic Bacteria," Symbiosis, 2012, pp. 161-171, vol. 57.
Xu, M., et al., "Bacterial Community Compositions of Tomato (*Lycopersicum esculentum* Mill.) Seeds and Plant Growth Promoting Activity of ACC Deaminase Producing Bacillus subtilis (HYT-12-1) on Tomato Seedlings" World J Microbiol Biotechnol., 2014, pp. 835-845, vol. 30.
Xu, Y., et al., "Biosynthesis of the Cyclooligomer Despipeptide bassianolide, an Insecticidal Virulence Factor of Beauveria bassiana," Fungal Genetics and Biology, 2009, pp. 353-364, vol. 46.
Xue, Q.Y., et al., "Evaluation of the Strains of Acinetobacter and Enterobacter as potential Biocontrol Agents Against Ralstonia Wilt of Tomato," Biological Control, 2009, vol. 48, pp. 252-258.

(56) References Cited

OTHER PUBLICATIONS

Yandigeri, M. S., et al., "Drought-tolerant endophytic actinobacteria promote growth of wheat (*Triticum aestivum*) under water stress conditions," Plant Growth Regulation, 2012, pp. 411-420, vol. 68.
Yashiro et al., "Effect of Streptomycin Treatment on Bacterial Community Structure in the Apple Phyllosphere," PLOS ONE, May 21, 2012, vol. 7, No. 5, 10 pages.
Yennamalli, R., et al., "Endoglucanases: insights into thermostability for biofuel applications", Biotech Biofuels, 2013, vol. 6, Issue 136, pp. 1-9.
Yezerski, A., et al., "The Effects of the Presence of Stored Product Pests on the Microfauna of a Flour Community," Journal of Applied Microbiology, 2005, pp. 507-515, vol. 98.
Youssef, Y.A., et al., "Production of Plant Growth Substances by Rhizosphere Myoflora of Broad Bean and Cotton," Biologia Plantarum, 1975, pp. 175-181, vol. 17, No. 3.
Zhang, Y., et al., "BcGsl, a glycoprotein from Botrytis cinerea, elicits defence response and improves disease resistance in host plants. Biochemical and biophysical research communications," Biochemical and Biophysical Research Communications, 2015, vol. 457, No. 4, pp. 627-634.
Zhang, W., et al., Host range of Exserohilum monoceras, a potential bioherbicide for the control of *Echinochloa* species, Canadian Journal of Botany/ Journal Canadien de Botan, National Research Council, Ottawa, CA, vol. 75, Jan. 1, 1997, pp. 685-692.
Zhang, J., et al. "Isolation and Characterization of Plant Growth-Promoting Rhizobacteria from Wheat Roots by Wheat Germ Agglutinin Labeled with Fluorescein Isothiocyanate", The Journal Of Microbiology, Apr. 27, 2012, vol. 50, No. 2, pp. 191-198, GenBank Accession No. JN210900.
Zhao, J.H., et al., "Bioactive secondary metabolites from *Nigrospora* sp. LLGLM003, an endophytic fungus of the medicinal plant *Moringa oleifera* Lam." World Journal of Microbiology and Biotechnology, Kluwer Academic Publishers, Feb. 12, 2012, pp. 2107-2112, vol. 28, No. 5.
Zhou, W., et al., "Effects of the Fungal Endophyte *Paecilomyces* sp. in Cotton on the Roo-Knot Nematode *Meloidogyne incognita*," poster dated Jan. 7, 2013.
Zhao, Jun, et al., "Effects of organic-inorganic compound fertilizer with reduced chemical fertilizer application on crop yields, soil biological activity and bacterial community structure in a rice-wheat cropping system," Applied Soil Ecology, vol. 99, Nov. 28, 2015, pp. 1-12, XP055530937.
Zhu et al., "*Helminthosporium velutinum* and *H. aquaticum* sp. nov. from aquatic habitats in Yunnan Province, China." Phytotaxa, 2016, vol. 253, No. 3, pp. 179-190.
Zimmerman, N.B., et al., "Fungal Endophyte Communities Reflect Environmental Structuring Across a Hawaiian Landscape," Proc Natl Acad Sci USA, 2012, pp. 13022-13027, vol. 109, No. 32.
Zuniga, A., et al., "Quorum Sensing and Indole-3-Acetic Acid Degradation Play a Role in Colonization and Plant Growth Promotion of *Arabidopsis thaliana* by Burkholderia phytofirmans PsJN," Mol Plant Microbe Interact., 2013, pp. 546-553, vol. 26, No. 5.
PCT International Search Report and Written Opinion for PCT/AU2018/050387, dated Jul. 12, 2018, 8 pages.
PCT International Search Report and Written Opinionfor PCT/US2018/051467, dated Mar. 25, 2019 26 pages.
PCT Invitation to Pay Additional Fees, PCT Application No. PCT/CA2013/000091, dated Mar. 27, 2013, 2 Pages.
PCT International Search Report and Written Opinion for PCT/CA2013/000091, dated Sep. 20, 2013, 17 Pages.
PCT International Search Report and Written Opinion for PCT/EP2013/062976, dated Dec. 22, 2014, 9 Pages.
PCT International Search Report, Application No. PCT/US2014/044427, dated Dec. 3, 2014, 9 Pages.
PCT International Search Report and Written Opinion, Application No. PCT/US2014/054160, dated Dec. 9, 2014, 21 Pages.
PCT Invitation to Pay Additional Fees, PCT Application No. PCT/US2014/064411, dated Feb. 5, 2015, 2 Pages.

PCT International Search Report and Written Opinion, International Application No. PCT/US2014/064411, dated Mar. 27, 2015, 15 Pages.
PCT Invitation to Pay Additional Fees, PCT Application No. PCT/US2014/072399, dated Apr. 14, 2015, 2 Pages.
PCT International Search Report and Written Opinion, International Application No. PCT/US2014/072399, dated Jun. 26, 2015, 22 Pages.
PCT Invitation to Pay Additional Fees, PCT Application No. PCT/US2014/072400, dated Apr. 16, 2015, 6 Pages.
PCT International Search Report and Written Opinion, Application No. PCT/US2014/072400, dated Jul. 8, 2015, 38 Pages.
PCT International Search Report and Written Opinion, Application No. PCT/AU2015/000360, dated Aug. 5, 2015, 12 Pages.
PCT Invitation to Pay Additional Fees, PCT Application No. PCT/US2015/038110, dated Sep. 22, 2015, 8 Pages.
PCT Invitation to Pay Additional Fees, PCT Application No. PCT/US2015/038187, dated Oct. 14, 2015, 5 Pages.
PCT International Search Report and Written Opinion, PCT Application No. PCT/US2015/038187, dated Jan. 22, 2016, 36 Pages.
Hanson, Le., "Reduction of Verticillium Wilt Symptoms in Cotton Following Seed Treatment with Trichoderma virens," Proceedings Beltwide Cotton Conferences, 2000, vol. 1. (Abstract), 1 Page.
Hardegree, S. P. et al., "Effect of Polyethylene Glycol Exclusion on the Water Potential of Solution-Saturated Filter Paper," Plant Physiol., 1990, pp. 462-466, vol. 92.
Hardoim, P. R., et al., "Assessment of Rice Root Endophytes and Their Potential for Plant Growth Promotion," In Hardoim, P.R., Bacterial Endophytes of Rice—Their Diversity, Characteristics and Perspectives, Groningen, 2011, pp. 77-100.
Hardoim, P.R., et al., "Dynamics of Seed-Borne Rice Endophytes on Early Plant Growth Stages," PLoS ONE, 2012, vol. 7, No. 2, 13 Pages.
Harman, G.E., et al., "Symposium: biocontrol and biotechnological methods for controlling cotton pests," Proceedings of the Beltwide Cotton Production Research Conf., 1989, Memphis, Tennessee, USA, pp. 15-20. (Abstract).
Hepler, P. K., et al., "Polarized Cell Growth in Higher Plants," Annu Rev Cell Dev Biol., 2001, pp. 159-187, vol. 17.
Hiatt, E.E., et al., "Tall Fescue Endophyte Detection: Commerical Immunoblot Test Kit Compared with Microscopic Analysis," Crop Science, 1999, pp. 796-799, vol. 39.
Hibbett, D.S., et al., "A Higher-Level Phylogenetic Classification of the Fungi," Mycol Res., 2007, pp. 509-547, vol. 111.
Hill, N. S., et al., "Endophyte Survival during Seed Storage: Endophyte-Host Interactions and Heritability," Crop Sci., 2009, pp. 1425-1430, vol. 49.
Hill N. S., et al., "Endophyte Survival during Seed Storage: Endophyte-Host Interactions and Heritability," PowerPoint, Dept. Crop Soil Sciences, University of Georgia, Nov. 16, 2012, 3 Pages.
Hinton, D. M., et al., "Enterobacter cloacae is an endophytic symbiont of corn," Mycopathologia, 1995, pp. 117-125, vol. 129.
Hjort, K., et al., "Chitinase genes revealed and compared in bacterial isolates, DNA extracts and a metagenomic library from a phytopathogen-suppressive soil", FEMS Microbiology Ecology, Feb. 2010, vol. 71, No. 2, pp. 197-207.
Hoffman, M., et al., "Diverse Bacteria Inhabit Living Hyphae of Phylogenetically Diverse Fungal Endophytes," Applied and Environmental Microbiology, Jun. 2010, p. 4063-4075, vol. 76, No. 12.
Hoffman, M., et al., "Endohyphal Bacterium Enhances Production of Indole-3-Acetic Acid by a Foliar Fungal Endophyte," PLOS One, Sep. 24, 2013, pp. 1-8, vol. 8, Issue 9, e73132.
Howell, C.R., et al., "Induction of Terpenoid Synthesis in Cotton Roots and Control of Rhizoctonia solani by Seed Treatment with Trichoderma virens," Phytopathology, 2000, pp. 248-252, vol. 90, No. 3.
Hubbard, M., et al., 2011. "Agricultural Potential of Fungal Endophytes of Grasses, Cereals and Wheat," In: Wheat: Genetics, Crops and Food Production. Nova Science Publishers Hauppauge, pp. 333-345.
Hubbard, M., et al., "Fungal Endophytes Improve Wheat Seed Germination Under Heat and Drought Stress," Botany, 2012, pp. 137-149, vol. 90.

(56) References Cited

OTHER PUBLICATIONS

Humann, J., et al., "Complete genome of the onion pathogen Enterobacter cloacae EcWSU1 ," Standard in Genomic Sciences, Dec. 31, 2011, vol. 5, No. 3, pp. 279-286.
Hung, P.Q., et al., "Isolation and Characterization of Endophytic Bacteria in Soybean (*Glycine* sp.)," Omonrice, 2004, pp. 92-101, vol. 12.
Idris, A., et al., "Efficacy of Rhizobacteria for Growth Promotion in Sorghum Under Greenhouse Conditions and Selected Modes of Action Studies," J Agr Sci., 2009, pp. 17-30, vol. 147.
Ikeda, S., et al., "The Genotype of The Calcium/Calmodulin-Dependent Protein Kinase Gene (CCaMK) Determines Bacterial Community Diversity in Rice Roots Under Paddy And Upland Field Conditions," Applied and Environmental Microbiology, 2011, pp. 4399-4405, vol. 77, No. 13.
Imoto, K., et al., "Comprehensive Approach to Genes Involved in Cell Wall Modifications in *Arabidopsis thaliana*," Plant Mol Biol., 2005, pp. 177-192, vol. 58.
Impullitti, A.E., et al., "Fungal endophyte diversity in soybean", Journal of Applied Microbiolog, vol. 114, No. 5, May 1, 2013, pp. 1500-1506.
Iverson, C., et al., "The taxonomy of Enterobacter sakazakii: proposal of a new genus *Cronobacter* gen. nov. and descriptions of Cronobacter sakazakii comb. nov. *Cronobacter sakazakii* subsp. *sakazakii*, comb, nov., *Cronobacter sakazakii* subsp. *malonaticus* subsp. nov., *Cronobacter turicensis* sp. nov., *Cronobacter muytjensii* sp. nov., *Cronobacter dublinensis* sp. nov. and *Cronobacter* genomospecies I", BMC Evolutionary Biology 2007, Apr. 17, 2017, 11 pages.
Janda, J.M., et al., "16S rRNA Gene Sequencing for Bacterial Identification in the Diagnostic Laboratory: Pluses, Perils, and Pitfalls," Journal of Clinical Microbiology, 2007, pp. 2761-2764, vol. 45, No. 9.
Joe, M.M. et al., "Development of alginate-based aggregate inoculants of *Methylobacterium* sp. And Azospirillum brasilense tested under in vitro conditions to promote plant growth," Journal of Applied Microbiology 2013, 116 (2):408-423, XP055225426, Nov. 22, 2013.
Johnston-Monje, D., et al., "Conservation and Diversity of Seed Associated Endophytes in Zea Across boundaries of Evolution, Ethnography and Ecology," PLoS ONE, 2011, vol. 6, No. 6, 22 Pages.
Johnston-Monje, D., et al., "Plant and Endophyte Relationships: Nutrient Management," Comprehensive Biotechnol., 2011, pp. 713-727, vol. 4.
Johnston-Monje, D., "Microbial Ecology of Endophytic Bacteria in Zea Species as Influenced by Plant Genotype, Seed Origin, and Soil Environment," Thesis, University of Guelph, 2011, 230 Pages.
Jones, K.L., "Fresh Isolates of Actinomycetes in which the Presence of Sporogenous Aerial Mycelia is a Fluctuating Characteristic," J Bacteriol., 1949, pp. 141-145, vol. 57, No. 2.
Jung, C., et al., "The Effects of Endohyphal Bacteria on Anti-Cancer and Anti-Malaria Metabolites of Endophytic-Fungi," Honors Thesis, University of Arizona, May 2012, 15 Pages.
Kaga, H., et al., "Rice Seeds as Sources of Endophytic Bacteria," Microbes Environ., 2009, pp. 154-162, vol. 24, No. 2.
Kalns, L., et al., "The Effects of Cotton Fungal Endophytes in the Field on Arthropod Community Structure," Power Point Presentation dated Jan. 7, 2013, 17 Pages.
Kanbar, A., et al., "Relationship between Root and Yield Morphological Characters in Rainfed Low Land Rice (*Oryza sativa* L.)," Cereal Research Communications, 2009, vol. 37, No. 2, pp. 261-268.
Kang, B. H., et al., "Members of the *Arabidopsis* Dynamin-Like Gene Family, ADL1, are Essential for Plant Cytokinesis and Polarized Cell Growth," Plant Cell, 2003, pp. 899-913, vol. 15.
Kasana, R. C., et al., "A Rapid and Easy Method for the Detection of Microbial Cellulases on Agar Plates Using Gram's Iodine," Curr Microbiol., 2008, pp. 503-507, vol. 57.

Khan, A.L., et al., "Salinity Stress Resistance Offered by Endophytic Fungal Interaction Between Penicillium minioluteum LHL09 and Glycine max. L," J. Microbiol. Biotechnol., 2011, pp. 893-902, vol. 21, No. 9.
Kim, M., et al., "Towards a taxonomic coherence between average nucleotide identity and 16S rRNA gene sequence similarity for species demarcation of prokaryotes", Int J Systematic Evolutionary Microbiol., 2014, vol. 64, pp. 346-351.
Klaubauf, S., et al., "Molecular diversity of fungal conmunities in agricultural soils from Lower Austria," Fungal Diversity, Aug. 13, 2010, pp. 65-75, vol. 44, No. 1.
Knapp, D., et al., "Inter- and intraspecific functional diversity of fungal root endophytes of semiarid sandy grasslands," Acta Microbiologica et Immunologica Hungarica, Nov. 2017, vol. 64, Issue Supplement 1, pp. 1-101.
Kruger, M., et al., "DNA-Based Species Level Detection of Glomeromycota: One PCR Primer Set for All *Arbuscular mycorrhizal* Fungi," New Phytol., 2009, pp. 212-223, vol. 183.
Kuklinsky-Sobral, J., et al., "Isolation and Characterization of Endophytic Bacteria from Soybean (*Glycine max*) Grown in Soil Treated with Glyphosate Herbicide," Plant and Soil, 2005, pp. 91-99, vol. 273.
Kuklinsky-Sobral, J., et al., "Isolation and characterization of soybean-associated bacteria and their potential for plant growth promotion," Environmental Microbiology, 2004, pp. 1244-1251, vol. 6, No. 12.
Kumar, S., et al., "MEGA7: Molecular Evolutionary Genetics Analysis version 7.0 for bigger datasets," Molecular Biology and Evolution, Mar. 22, 2016, vol. 33, pp. 1870-1874.
Kumar, A., et al., "Bio-control potential of *Cladosporium* sp. (MCPL-461), against a noxious weed *Parthenium hysterophorus* L.," J. Environ Biol., Mar. 2009, pp. 307-312, vol. 30, Issue 2.
Kusari, S., et al. "Chemical ecology of endophytic fungi: origins of secondary metabolites," Cell Press, Chem & Biol, vol. 19, pp. 792-798, 2012.
Labeda, D.P., et al., "Phylogenetic study of the species within the family Streptomycetaceae," Antonie van Leeuwenhoek, 2012, vol. 101, pp. 73-104, Springer.
Lanver, D., et al., "Sho1 and Msb2-Related Proteins Regulate Appressorium Development in the Smut Fungus *Ustilago aydis*," Plant Cell, 2010, pp. 2085-2101, vol. 22.
Le, X.H., et al., "Isolation and characterisation of endophytic actinobacteria and their effect on the early growth and nodulation of lucerne (*Medicago sativa* L.)," 17th Australian Nitrogen Fixation Conference 2014 Proceedings, Sep. 29, 2014, ed. Gupta, V.V.S.R., Unkovich, M. and Kaiser, B. N., ASNF, University of Adelaide, pp. 134-136.
Lehman, S.G., "Treat Cotton Seed," Review of Applied Mycology, 1945, 24, 369, 16 Pages.
Bragantia, et al., "Identificaqao e Avaliaqao de Rizobacterias Isoladas de Raizes de Milho," Jan. 1, 2010, pp. 905-911, Retrieved from the Internet: URL:http://www.scielo.br/pdf/brag/v69n4/v69n4a17.pdf (With English Abstract).
Brinkmeyer, R., et al., "Uncultured Bacterium Clone ARKMP-100 16S Ribosomal RNA Gene, Partial Sequence," NCBI GenBank Accession No. AF468334, Submitted Jan. 14, 2002.
Brodie, E.L., et al., "Uncultured Bacterium Clone BANW722 16S Ribosomal RNA Gene, Partial Sequence," NCBI GenBank Accession No. DQ264636, Submitted Oct. 25, 2005, 1 Page.
Bulgarelli, D., et al., "Structure and Functions of the Bacterial Microbiota of Plants," Annu Rev Plant Biol., 2013, pp. 807-838, vol. 64.
Büttner, D., et al., "Regulation and secretion of Xanthomonas virulence factors," FEMS Microbiology Reviews, 2010, pp. 107-133, vol. 34, No. 2.
Caporaso, J.G., et al., "Ultra-High-Throughput Microbiol Community Analysis on the Illumina HiSeq and MiSeq Platforms," ISME J., 2012, pp. 1621-1624, vol. 6.
Castillo, D., et al., "Fungal Entomopathogenic Endophytes: Negative Effects on Cotton Aphid Reproduction in Greenhouse and Field Conditions," Power Point Presentation dated Mar. 23, 2013, 21 Pages.
Castillo, D., et al., "Fungal Endophytes: Plant Protective Agents Against Herbivores," Power Point Presentation dated Aug. 4, 2013.

(56) References Cited

OTHER PUBLICATIONS

Cavalier-Smith, T., "A Revised Six-Kingdom System of Life," Biol Rev Camb Philos Soc., 1998, pp. 203-266, vol. 73.
Cha, C., et al., "Production of Acyl-Homoserine Lactone Quorum-Sensing Signals by Gram-Negative Plant Associated Bacteria," Mol Plant Microbe Interact., 1998, pp. 1119-1129, vol. 11, No. 11.
Chagas, F., et al., "A Mixed Culture of Endophytic Fungi Increases Production of Antifungal Polyketides," J. Chem Ecol., Oct. 2013, pp. 1335-1342, vol. 39.
Chenhua Li, et al., "Change in deep soil microbial communities due to long-term fertilization," Soil Biology and Biochemistry, vol. 75, Mar. 5, 2014, pp. 264-272, XP055530941.
Cheow, W.S., et al., "Biofilm-like Lactobacillus rhamnosus Probiotices Encapsulated in Algiinate and Carrageenan Microcapsules Exhibiting Enhanced Thermotolerance and Freeze-drying Resistance," Biomacromolecules 2013, vol. 14(9):3214-3222.
Chernin, L. S., et al., "Chitinolytic Activity in Chromobacterium violaceum: Substrate Analysis and Regulation by Quorum Sensing," J Bacteriol, 1998, pp. 4435-4441, vol. 180, No. 17.
Clark, E. M., et al., "Improved Histochemical Techniques for the Detection of Acremonium coenophilum in Tall Fescue and Methods of in vitro Culture of the Fungus," J Microbiol Methods, 1983, pp. 149-155, vol. 1.
Clarridge, J., "Impact of 16S rRNA Gene Sequence Analysis for Identification of Bacteria on Clinical Microbiology and Infectious Diseases," Clinical Microbiology Reviews, Oct. 2004, pp. 840-862, vol. 17, No. 4.
Clay, K., "Effects of fungal endophytes on the seed and seedling biology of Lolium perenne and Festuca arundinacea," Oecologia, 1987, pp. 358-362, vol. 73.
Clough, S. J., et al., "Floral Dip: A Simplified Method for Agrobacterium-mediated Transformation of *Arabidopsis thaliana*," Plant J., 1998, pp. 735-743, vol. 16, No. 6.
Compant, S., et al., "Endophytes of Grapevines Flowers, Berries, and Seeds: Identification of Cultivable Bacteria, Comparison with Other Plant Parts, and Visualization of Niches of Colonization," Microbial Ecology, 2011, pp. 188-197, vol. 62.
Compant, S., et al., "Endophytic colonization of Vitis vinfera L. by Burkholderia phytofirmans strain PsJN: from the rhizosphere to inflorescence tissues," FEMS Microbiol Ecol, 2008, pp. 84-93, vol. 63.
Conn, V. M., "Effect of Microbial Inoculants on the Indigenous Actinobacterial Endophyte Population in the Roots of Wheats as Determined by Terminal Restriction Fragment Length Polymorphism," Applied and Environmental Microbiology, 2004, pp. 6407-6413, vol. 70, No. 11.
Cottyn, B., et al., "Phenotypic and genetic diversity of rice seed-associated bacteria and their role in pathogenicity and biological control," Journal of Applied Microbiology, 2009, pp. 885-897, vol. 107.
Cox, C. D., "Deferration of Laboratory Media and Assays for Ferric and Ferrous Ions," Methods Enzymol., 1994, pp. 315-329, vol. 235.
Craine, J. M., et al., "Global Diversity of Drought Tolerance and Grassland Climate-Change Resilience," Nature Climate Change, 2013, pp. 63-67, vol. 3.
Dalal, J.M., et al., "Utilization of Endophytic Microbes for Induction of Systemic Resistance (ISR) in Soybean (*Glycine max* (L) Merril) Against Challenge Inoculation with R. solani," Journal of Applied Science and Research, 2014, pp. 70-84, vol. 2, No. 5.
Danhorn, T., et al., "Biofilm Formation by Plant-Associated Bacteria," Annu Rev Microbiol., 2007, pp. 401-422, vol. 61.
Daniels, R., et al., "Quorum Signal Molecules as Biosurfactants Affecting Swarming in Rhizobium etli," PNAS, 2006, pp. 14965-14970, vol. 103, No. 40.
Darsonval, A., et al., "Adhesion and Fitness in the Bean Phyllosphere and Transmission to Seed of *Xanthomonas fuscans* subsp. *fuscans*," Molecular Plant-Microbe Interactions, 2009, pp. 747-757, vol. 22, No. 6.
Darsonval, A., et al., "The Type III Secretion System of *Xanthomonas fuscans* subsp. *fuscans* is involved in the Phyllosphere Colonization Process and in Transmission to Seeds of Susceptible Beans," Applied and Environmental Microbiology, 2008, pp. 2669-2678, vol. 74, No. 9.
Dbget, "Orthology: K14454," 2005, 2 pages, can be retrieved at <URL:http://www.genome.jp/dbget-bin/wwwbget?ko:K14454>.
De Freitas, J. R., et al., "Phosphate-Solubilizing Rhizobacteria Enhance the Growth and Yield but not Phosphorus Uptake of Canola (*Brassica napus* L.)," Biol Fertil Soils, 1997, pp. 358-364, vol. 24.
De Santi, M. et al., "A combined morphologic and molecular approach for characterizing fungal microflora from a traditional Italian cheese (Fossa cheese)," Inter. Dairy J., 2010, vol. 10, No. 7, pp. 465-471.
De Lima Favaro, L. C., et al., "Epicoccum nigrum P16, a Sugarcane Endophyte, Produces Antifungal Compounds and Induces Root Growth," PLoS One, 2012, pp. 1-10, vol. 7, No. 6.
De Medeiros, L., et al., "Evaluation of Herbicidal Potential of Depsides from Cladosporium uredinicola an Endophytic Fungus found in Guava Fruit," J. Braz. Chem. Soc., 2012, vol. 23, No. 8, p. 1551-1557.
De Souza, J. J., et al., "Terpenoids from Endophytic Fungi," Molecules, 2011, pp. 10604-10618, vol. 16, No. 12.
Dennis, C., et al., "Antagonistic Properties of Species Groups of Trichoderma," Trans Brit Mycol Soc, 1971, pp. 25-39, vol. 57, No. 1.
Desiro, A., et al., "Detection of a novel intracellular microbiome hosted in arbuscular mycorrhizal fungi," ISME Journal, 2014, pp. 257-270, vol. 8.
Don, R.H., et al., "Properties of Six Pesticide Degradation Plasmids Isolated From Alcaligenes Paradoxus and Alcaligenes eutrophus," J Bacteriol., 1981, pp. 681-686, vol. 145, No. 2.
Eberhard, A., et al., "Structural Identification of Autoinducer of Photobacterium fischeri Luciferase," Biochem., 1981, pp. 2444-2449, vol. 20.
Edgar, R. C., "Search and Clustering Orders of Magnitude Faster than BLAST," Bioinformatics, 2010, pp. 2460-2461, vol. 26, No. 19.
Edgar, R. C., "UPARSE: Highly Accurate OTU Sequences From Microbial Amplicon Reads," Nat. Methods, 2013, pp. 996-998, vol. 10, No. 10.
Ek-Ramos, M. J., "Ecology, Distribution and Benefits of Fungal Endophytes Isolated from Cultivated Cotton (*Gossypium hirsutum*) in Texas," Power Point Presentation dated Nov. 7, 2012, 27 Pages.
Ek-Ramos, M. J., et al., "Spatial and Temporal Variation in Fungal Endophyte Communities Isolated from Cultivated Cotton (*Gossypium hirsutum*)," PLoS ONE, 2013, vol. 8, No. 6, 13 Pages, e66049.
Ek-Ramos, M. J., et al., "Spatial and Temporal Variation in Fungal Endophyte Communities Isolated from Cultivated Cotton (*Gossypium hirsutum*)," Power Point Presentation dated Jan. 7, 2013.
El-Shanshoury, A. R., "Growth Promotion of Wheat Seedlings by Streptomyces atroolivaceus," Journal of Agronomy and Crop Science, 1989, pp. 109-114, vol. 163.
Emerson, D., et al., "Identifying and Characterizing Bacteria in an Era of Genomics and Proteomics," BioScience, 2008, pp. 925-936, vol. 58, No. 10.
Endre, G., et al., "A Receptor Kinase Gene Regulating Symbiotic Nodule Development," Nature, 2002, pp. 962-966, vol. 417.
Faria, D. C., et al., "Endophytic Bacteria Isolated from Orchid and Their Potential to Promote Plant Growth," World J Microbiol Biotechnol., 2013, pp. 217-221, vol. 29.
Fatima Z et al., "Antifungal activity of plant growth-promoting rhizobacteria isolates against Rhizoctonia solani in wheat", African Journal of Biotechnology, 2009, 8:219-225.
Ferrando, L., et al., "Molecular and Culture-Dependent Analyses Revealed Similarities in the Endophytic Bacterial Community Composition of Leaves from Three Rice (*Oryza sativa*) Varieties," FEMS Microbiol Ecol., 2012, pp. 696-708, vol. 80.
Normander, B., et al., "Bacterial Origin and Community Composition in the Barley Phytosphere as a Function of Habitat and Presowing Conditions," Appl Environ Microbiol., Oct. 2000, pp. 4372-4377, vol. 66, No. 10.

(56) References Cited

OTHER PUBLICATIONS

Ogbo, F., et al., "Some Characteristics of a Plant Growth Promoting; i*Enterobacter*/isp. Isolated from the Roots of Maize", Advances in Microbiology, Jan. 1, 2012, vol. 02, No. 03, pp. 368-374.

O'Hanlon, K., et al., "Exploring the potential of symbiotic fungal endophytes in cereal disease suppression", Biological Control, vol. 63, No. 2, Sep. 5, 2012, pp. 69-78.

Okunishi, S., et al., "Bacterial Flora of Endophytes in the Maturing Seeds of Cultivated Rice (*Oryza sativa*)," Microbes and Environment, 2005, pp. 168-177, vol. 20, No. 3.

Op De Beeck, M., et al., "Comparison and Validation of Some ITS Primer Pairs Useful for Fungal Metabarcoding Studies," PLOS ONE, Jun. 2014, vol. 9, Issue 6, e97629, pp. 1-11.

Orakçi Ge et al, "Selection of antagonistic actinomycete isolates as biocontrol agents against root-rot fungi", Fresenius Environmental Bulletin, 2010, 19: 417-424 & GenBank Accession No. GQ475299, Oct. 5, 2009.

Orole, O. O., et al., "Bacterial and fungal endophytes associated with grains and roots of maize," Journal of Ecology and the Natural Environment, 2011, pp. 298-303, vol. 3, No. 9.

Partida-Martinez, L.P., et al., "The Microbe-Free Plant: Fact or Artifact?" Front Plant Sci., 2011, vol. 2, No. 100, 16 Pages.

Partida-Martinez, L.P., et al., "Endosymbiont-Dependent Host Reproduction Maintains Bacterial-Fungal Mutualism", Current Biology, May 1, 2007, vol. 17, No. 9, pp. 773-777.

Pearson, W.R., et al., "Rapid and Sensitive Sequence Comparison With FASTP and FASTA," Methods Enzymol., 2011, pp. 63-98, vol. 183.

Pedraza, R.O., et al., "Azospirillum inoculation and nitrogen fertilization effect on grain yield and on the diversity of endophytic bacteria in the phyllosphere of rice rainfed crop," European Journal of Soil Biology, 2009, pp. 36-43, vol. 45.

Perez-Fernandez, M.A., et al., "Simulation of Germination of Pioneer Species Along an Experimental Drought Gradient," J Environ Biol., 2006, pp. 669-685, vol. 27, No. 4.

Perez-Miranda, S., et al., "O-CAS, A Fast and Universal Method for Siderophore Detection," J Microbiol Methods, 2007, pp. 127-131, vol. 70.

Petti, C. A., "Detection and Identification of Microorganisms by Gene Amplification and Sequencing," Clinical Infectious Diseases, 2007, pp. 1108-1114, vol. 44.

Philippot, L., et al., "Going Back to the Roots: The Microbial Ecology of the Rhizosphere," Nat Rev Microbiol., Nov. 2013, pp. 789-799, vol. 11.

Philrice Batac, Philippine Rice R&D Highlights, 2012, Area-Based R&D Projects, [online][Retrieved Aug. 11, 2016] Retrieved from the Internet URL:http://www.philrice.gov.ph/2012-rd-highlights/, 52 Pages.

Pillay, V. K., et al., "Inoculum Density, Temperature, and Genotype Effects on in vitro Growth Promotion and Epiphytic and Endophytic Colonization of Tomato (*Lycopersicon esculentum* L.) Seedlings Inoculated with a Pseudomonad Bacterium," Can J Microbiol., 1997, pp. 354-361, vol. 43.

Powell, W. A., et al., "Evidence of Endophytic Beauveria Bassiana in Seed-Treated Tomato Plants Acting as a Systemic Entomopathogen to Larval Helicoverpa zea (Lepidoptera: Noctuidae)," J. Entomol. Sci., 2009, pp. 391-396, vol. 44, No. 4.

Quadt-Hallmann, A, et al., "Bacterial Endophytes in Cotton: Mechanisms of Entering the Plant," Can J Microbiol., 1997, pp. 577-582, vol. 43.

R Core Team, "R: A Language and Environment for Statistical Computing," R Foundation for Statistical Computing, Vienna, Austria, May 2013, ISBN: 3-900051-07-0. Available online at http://www.R-25project.org/, 3604 Pages.

Rae, R., et al., "A subset of naturally isolated Bacillus strains show extreme virulence to the free-living nematodes Caenorhabditis elegans and Pristionchus pacificus", Environmental Microbiology, vol. 12, No. 11, 2010, pp. 3007-3021.

Rasmussen, S., et al., "Grass-endophyte interactions: a note on the role of monosaccharide transport in the Neotyphodium lolii-Lolium perenne symbiosis," New Phytologist, 2012, pp. 7-12, vol. 196.

Ravel, C., et al., "Beneficial effects of Neotyphodium lolii on the growth and the water status in perennial ryegrass cultivated under nitrogen deficiency or drought stress," Agronomie, 1997, pp. 173-181, vol. 17.

Reiter, B., et al., "Response of Endophytic Bacterial Communities in Potato Plants to Infection with *Erwinia carotovora* subsp. *atroseptica*," Appl Environ Microbiol., 2001, pp. 2261-2268, vol. 68, No. 5.

Ren, Y., et al., "Complete Genome Sequence of *Enterobacter cloacae* subsp. *cloacae* Type Strain ATCC 13047," J. Bacteriol. May 2010, vol. 192, No. 9, pp. 2463-2464.

Riess, K., et al., "High genetic diversity at the regional scale and possible speciation in Sebacina epigaea and S. incrustans," BMC Evolutionary Biology, 2013, vol. 13, No. 102, 17 Pages.

Riken, GI No. GMFL01-01-D03, 2 Pages, [online] [Retrieved on Dec. 18, 2017] Retrieved from the internet <URL:http://spectra.psc.riken.jp/menta.cgi/rsoy/datail?id=GMFL01-01-D03>.

Rodriguez, H., et al., "Expression of a Mineral Phosphate Solubilizing Gene From Erwinia herbicola in Two Rhizobacterial Strains," J Biotechnol., 2001, pp. 155-161, vol. 84.

Rodriguez, R.J., et al., "Stress Tolerance in Plants via Habitat-Adapted Symbiosis," ISME J., 2008, pp. 404-416, vol. 2.

Rodriguez-Navarro, D., et al., "Soybean Interactions with Soil Microbes, Agronomical and Molecular Aspects," Agronomy for Sustainable Development, 2011, pp. 173-190, vol. 31, No. 1.

Roessner, U., et al., "Metabolic Profiling Allows Comprehensive Phenotyping of Genetically or Environmentally Modified Plant Systems," Plant Cell, 2001, pp. 11-29, vol. 13.

Rosado, A. S., et al., "Phenotypic and Genetic Diversity of Paenibacillus azotofixans Strains Isolated from the Rhizoplane or Rhizosphere Soil of Different Grasses," J App Microbiol., 1998, pp. 216-226, vol. 84.

Rosenblueth, A., et al., "Seed Bacterial Endophytes: Common Genera, Seed-to-Seed Variability and Their Possible Role in Plants," Acta Hort., 2012, pp. 39-48, vol. 938.

Rosenblueth, M., et al., "Bacterial Endophytes and Their Interactions With Host," Molecular Plant-Microbe Interactions, 2006, pp. 827-837, vol. 19, No. 8.

Ross, P.L., et al., "Multiplexed Protein Quantitation in *Saccharomyces cerevisiae* Using Amine-Reactive Isobaric Tagging Reagents," Mol Cell Proteomics, 2004, pp. 1154-1169, vol. 3, No. 12.

Saleem, M., et al., "Perspective of Plant Growth Promoting Rhizobacteria (PGPR) Containing ACC Deaminase in Stress Agriculture," J Ind Microbiol Biotechnol, Oct. 2007, pp. 635-648, vol. 34.

Samac, D.A., et al., "Recent Advances in Legume-Microbe Interactions: Recognition, Defense Response, and Symbiosis from a Genomic Perspective," Plant Physiol., 2007, pp. 582-587, vol. 144.

Samways, M.J., et al., "Assessment of the Fungus *Cladosporium oxyspoum* (Berk. And Curt.) As a Potential BioControl Agent Against Certain Homoptera," Elsevier Science Publishers B.V., Jan. 1, 1986, pp. 231-239.

Sardi, P , et al., "Isolation of Endophytic Streptomyces Strains from Surface Sterilized Roots," Applied and Environmental Microbiology, 1992, pp. 2691-2693, vol. 58, No. 8.

Sarkar, S., et al., "New report of additional enterobacterial species causing wilt in West Bengal, India," Canadian Journal of Microbiology, 2015, vol. 61, No. 7, pp. 477-486.

Sarwar, M., et al., "Tryptophan Dependent Biosynthesis of Auxins in Soil," Plant Soil, 1992, pp. 207-215, vol. 147.

Saunders, M., et al., "Host-Synthesized Secondary Compounds Influence the In Vitro Interactions between Fungal Endophytes of Maize", Applied and Environmental Microbiology, Nov. 9, 2007, pp. 136-142, vol. 74, No. 1.

Schmieder, R., et al., "Quality Control and Preprocessing of Metagenomic Datasets," Bioinformatics, 2011, pp. 863-864, vol. 27, No. 6.

Schneider, C., et al., "Endophytes for plant protection: the state of the art Proceedings," DPG Spectrum Phytomedizin, Proceedings of

(56) References Cited

OTHER PUBLICATIONS the 5th International Symposium on Plant Protection and Plant Health in Europe, May 26-29, 2013, 347 Pages.
Schoch, C. L., et al., "Nuclear Ribosomal Internal Transcribed Spacer (ITS) Region as a Universal DNA Barcode Marker for Fungi," Proc Natl Acad Sci USA, 2012, pp. 6241-6246, vol. 109, No. 16.
Schwyn, B. et al., "Universal Chemical Assay for the Detection and Determination of Siderophores," Analytical Biochemistry, 1987, pp. 47-56, vol. 160.
NCBI, GenBankAccession No. KX641980.1, Jul. 29, 2017, Scott, M., et al., "*Dothideomycetes* sp. isolate FT14-6 internal transcribed spacer 1, partial sequence; 5.8S ribosomal RNA gene and internal transcribed spacer 2, complete sequence; and large subunit ribosomal RNA gene, partial sequence," 2 Pages, Can be retrieved at<URL:https://www.ncbi.nlm.nih.gov/nuccore/KX641980>.
Senthilkumar, M., et al., "Biocontrol Potential of Soybean Bacterial Endophytes Against Charcoal Rot Fungus, *Rhizoctonia batatiola*," Current Microbiology, 2009, vol. 58, pp. 288-293.
"Sequence Alignment of JQ047949 with Instant Seq ID No. 2," Search conducted on Jan. 2, 2019, 2 pages.
Sessitsch, A., et al., "*Burkholderia phytofirmans* sp. Nov., a novel plant-associated bacterium with plant-beneficial properties," International Journal of Systematic and Evolutionary Microbiology, 2005, pp. 1187-1192, vol. 55.
Invitation to Pay Additional Fees, PCT Application No. PCT/US2015/038110, dated Sep. 22, 2015, 8 Pages.
NCBI GenBank: Accession No. XP55670271, "*Enterobacter* sp. MLB05 16S ribosomal RNA gene, partial sequence—Nucleotide", Jun. 9, 2012, 1 Page, can be retreived at URL:https//www.ncbi.nlm.nih gov/nuccore/J Q765415.1/.
NCBI GenBank: Accession No. XP55670274, "*Enterobacter* sp. CR 6-3 16S ribosomal RNA gene, partial sequence—Nucleotide", Mar. 27, 2013, 1 Page, can be retreived at URL:https://www.ncbi.nlm nih.gov/nuccore/K C355340.
NCBI GenBank: Accession No. XP55670279, "Uncultured bacterium clone bb2s4 16S ribosomal RNA gene, partial seque—Nucleotide", May 6, 2005, 1 Page, can be retreived at URL:https://www.ncbi.nlm.nih.gov/nuccore/D Q068880.
European Patent Office, Communication Pursuant to Article 94(3) EPC for European Patent Application No. EP 14777213.1, dated Jun. 18, 2018, 4 Pages.
De Melo Pereira, G. V., et al. "A Multiphasic Approach for the Identification of Endophytic Bacterial in Strawberry Fruit and their Potential for Plant Growth Promotion," Microb. Ecology, 2012, pp. 405-417, vol. 63, No. 2.
Result 11 from a search in the GenEmbl database, GenEmbl Record No. EU 977189, Smith et al., "Bioactive endophytes warrant intensified exploration and conservation," PLoS ONE 3(8):E3052, 2008.
Result 3 from a search in the GenEmbl database, GenEmbl Record No. KF011597, Paenibacillus strain No. HA13, Park et al., "Isolation and characterization of humic substances-degrading bacteria from the subarctic Alaska grasslands," J Basic Microbiol, 2013.
PCT International Search Report and Written Opinion for PCT/US2018/051467, dated Feb. 4, 2019, 22 pages.
Chaves, J., et al., "Identification and Phylogeny of Streptomyces Based on Gene Sequences", Research Journal of Microbiology, vol. 13, No. 1, Dec. 15, 2017, pp. 13-20, XP055675917.
Girard, G., et al., "A novel taxonomic marker that discriminates between morphologically complex actinomycetes", Open Biology, vol. 3, No. 10, Oct. 2013, p. 130073,XP055675916.
Guo, Y., et al. "A multi locus phylogeny of the Streptomyces griseus 16S rRNA gene clade: use of multilocus sequence analysis for streptomycete systematics", International Journal of Systematic and Evolutionary Microbiology, vol. 58, No. 1, 2008, pp. 149-159, XP055675936.
PCT Invitation to Pay Additional Fees, PCT Application No. PCT/US2017/064292, dated Mar. 6, 2018, 15 Pages.

PCT International Search Report and Written Opinion, PCT Application No. PCT/US2017/068255, dated Mar. 19, 2018, 14 Pages.
PCT International Search Report and Written Opinion PCT/AU2018/050387, dated Jul. 12, 2018 (Filing date is Apr. 27, 2018).
PCT International Search Report and Written Opinion for PCT/US2017/064292, dated May 11, 2018, 20 Pages.
Bentley, S.D., et al., Complete genome sequence of the model actinomycete Streptomyces coelicolor A3(2), Nature. May 9, 2002;417(6885):141-7. (Year: 2002).
Gabor, J., et al., "Mycorrhizal fungi effects on nutrient composition and yield of soybean seeds," Journal of Plant Nutrition, 20:4-5, 581-591, 1997.
Gopalakrishnan, S. et al., "Plant growth-promoting activities of *Streptomyces* spp. In sorghum and rice", SpringerPlus, 2/1/574, pp. 1-8, http://www.springerplus.com/content/2/1/574, 2013.
Groppe, K., et al., "Interaction between the endophytic fungus *Epichloe bromicola* and the grass *Bromus erectus*: effects of endophyte infection, fungal concentration and environment on grass growth and flowering," Mol Ecol., 8:1827-1835, 1999.
Hubbard, M., "Fungal Endophytes that Confer Heat and Drought Tolerance to Wheat," Doctoral dissertation, University of Saskatchewan, 2012.
Keda, H., et al., "Complete genome sequence and comparative analysis of the industrial microorganism *Streptomyces avermitilis*," Nat Biotechnol. May 2003;21 (5) :526-31. Epub Apr. 14, 2003. (Year: 2003).
Lee, J., et al., "*Streptomyces koyangensis* sp. nov., a novel actinomycete that produces 4-phenyl-3-butenoic acid," Int J Syst Evol Microbial. Jan. 2005;55(Pt 1):257-62 (Year: 2005).
Lind, A., et al., "Drivers of genetic diversity in secondary metabolic gene clusters within a fungal species", PLOS Biology, Nov. 17, 2017, 26 pages.
Pacovsky, R., "Carbohydrate, protein and amino acid status of Glycine-Glomus-Bradyrhizobium symbioses," Physiologia Pantarium; 75:346-354, 1989).
Sha, T. et al., "Genetic diversity of the endemic gourmet mushroom *Thelephora ganbajun* from southwestern China", Microbiology (2008), 154, 3460-3468.
Sugita, T. et al., "Intraspecies Diversity of Cryptococcus laurentii as Revealed by Sequences of Internal Transcribed Spacer Regions and 28S rRNA Gene and Taxonomic Position of C. laurentii Clinical Isolates", Journal of Clinical Microbiology, Apr. 2000, p. 1468-1471.
Wiebold, M., et al., "Agriculture Experiment Station, College of Agriculture, Food & Natural Resources, University of Missouri, Special Report 589, pp. 1-124)."
Le, X.H., et al., "Effects of endophytic Streptomyces on the lucerne (*Medicago sativa* L.) symbiosis at different levels of nitrogen," 17th Australian Nitrogen Fixation Conference 2014 Proceedings, Sep. 29, 2014, ed. Gupta, V.V.S.R., Unkovich, M. and Kaiser, B. N., ASNF, University of Adelaide, pp. 66-67.
Alvarez-Perez, S., et al., "Zooming-in on floral nectar: a first exploration of nectar-associated bacteria in wild plant communities," FEMS Microbiol. Ecol., 2012, vol. 80, No. 3, pp. 591-602.
European Patent Office, Supplementary European Search Report, European Patent Application No. 13874703.5, dated Jun. 21, 2016, 3 Pages.
Invitation to Pay Additional Fees, PCT Application No. PCT/US2015/038187, dated Oct. 14, 2015, 5 Pages.
Coombs, J. T., et al., "Isolation and Identification of Actinobacteria from Surface-Sterilized Wheat Roots," Applied and Environmental Microbiolog,, 2003, pp. 5603-5608, vol. 69, No. 9.
Laus, M. C., et al., "Role of Cellulose Fibrils and Exopolysaccharides of Rhizobium leguminosarum in Attachment to and Infection of Vicia sativa Root Hairs," Mol Plant Microbe Internet., 2005, pp. 533-538, vol. 16, No. 6.
PCT International Search Report and Wlitten Opinion, PCT Application No. PCT/US2015/068206, dated Jun. 27, 2016, 20 Pages.
PCT International Search Report and Wrrtten Opinion, PCT Application No. PCT/US2016/030292, dated Aug. 12, 2016, 20 Pages.
PCT International Search Report and Wrrtten Opinion, PCT Application No. PCT/US2016/030293, dated Aug. 11, 2016, 23 Pages.

(56) References Cited

OTHER PUBLICATIONS

PCT International Search Report and Wlitten Opinion, PCT Application No. PCT/US2016/036504, dated Nov. 4, 2016, 18 Pages.
GenEmbl Database, GenEmbl Record No. JN872548.1, 2 Pages.
Soe, K.M, et al, "Evaluation of effective Myanmar Bradyrhizobium strains isolated from Myanmar soybean and effects of coinoculation with Streptomyces griseoglavus P4 for nitrogen fixation", Soil science and plant nutrition 59.3 (2013): 361-370 (Year: 2013).
Ngom, A et al., "A novel symbiotic nitrogen-fixing member of the Ochrobactrum clade isolated from root nodues of Acacia mangium" J. Gen. Appl. Microbiol. (2004) 50: 17-27.
Trujillo, M.E et al., "Nodulation of Lupinus albus by strins of *Ochrobactrum lupini* sp. nov." Appl. Environ Microbiol Mar. 2005; 71(3): 1318-1327.
Bal, H.B et al., "Isolation of ACC deaminase producting PGPR from rice rhizosphere and evaluating their plant growth promoting activity under salt stress". Plant Soil (2013) 366: 93-105 doi: 10/1007/s11104-012-1402-5.
Chakraborty et al., "Evaluation of Ochrobactrum anthropi TRS-2 and its talcbased formulation for enhancement of growth of tea plants and management of brown root rot disease." Journal of Applied Microbiology, 2009, 107(2):625-634 DOI:10.1111/j.1365-2672.2009.04242.x <https://doi.org/10.1111/j.1365-2672.2009.04242.x.
Bevivino, A., et al., "Characerization of free-living maize rhizosphere populatin of Burkholderia cepacia: effect of seed treatment on disease suppresssion and growth promotion of maize", FEMS Microbiology Ecology 27 (1998) 225-237.
Ciccillo, F., et al., Effects of two different application methods of Burkholderia ambifaria MCI 7 on plant growth and rhizospheric bacterial diversity.
Estrada, P., et al., "A N2-fixing endophytic *Burkholderia* sp. associated with maize plants culitvated in Mexico", Canadian Journal of Microbiology (2002), vol. 48(4), pp. 528-536.
Sharma, V.K., et al., "Enhancement of verticillium wilt resistance in tomato transplants by in vitro co-culture of seedlings with a plant growth promoting rhizobacterium (*Pseudomonas* sp. strain PsJN)", Canadian Journal of Microbiology (1998), vol. 44(6), pp. 285-294.
Grady, E., et al., "Current knowledge and perspectives of Paenibacillus: a review" Microb Cell Fact (2016) 15:203.
Li, J., et al., "Antitumour and antimicrobial activities of endophytic stretomycetes from pharmaceutical plants in rainforest", Lett Appl Microbiol. Dec. 2008; 47(6): 574-80. (Year: 2008).
Lehman, S.G., "Treat Cotton Seed," Research and Farming III, Progr. Rept., 1945, 3, 5, 16 Pages.
Leonard, C. A., et al., "Random Mutagenesis of the Aspergillus oryzae Genome Results in Fungal Antibacterial Activity," Int J Microbiol., 2013, vol. 2013, Article ID 901697, 6 Pages.
Li, H. M., et al., "Expression of a Novel Chitinase by the Fungal Endophyte in Poa ampla," Mycologia, 2004, pp. 526-536, vol. 96, No. 3.
Li, H., et al., "Endophytes and their role in phytoremediation," Fungal Diversity, 2012, pp. 11-18, vol. 54.
Li, M., et al., "ATP Modulates the Growth of Specific Microbial Strains", Current Microbiology, May 30, 2010, vol. 62, No. 1, pp. 84-89.
Liu, M., et al., "A Novel Screening Method for Isolating Exopolysaccharide-Deficient Mutants," Appl Environ Microbiol., 1998, pp. 4600-4602, vol. 64, No. 11.
Liu, Y., et al., "Investigation on Diversity and Population Succession Dynamics of Endophytic Bacteria from Seeds of Maize (*Zea mays* L., Nongda108) at Different Growth Stages," Ann Microbiol., 2013, pp. 71-79, vol. 63.
Liu, D., et al., "Osmotin Overexpression in Potato Delays Development of Disease Symptoms," Proc Natl Acad Sci USA, 1994, pp. 1888-1892, vol. 91.
Liu, Y., et al., "Phylogenetic relationships among ascomycetes: evidence from an RNA polymerase II subunit," Mol. Biol. Evol. 1999. vol. 16, No. 12, pp. 1799-1808.
Liu, Y., et al., "Study on Diversity of Endophytic Bacterial Communities in Seeds of Hybrid Maize and their Parental Lines," Arch Microbiol., 2012, pp. 1001-1012, vol. 194.
Long, H. H., et al., "The Structure of the Culturable Root Bacterial Endophyte Community of Nicotiana attenuata is Organized by Soil Composition and Host Plant Ethylene Production and Perception," New Phytol., 2010, pp. 554-567, vol. 185.
Lopez-Lopez, A., et al., "Phaseolus vulgaris Seed-Borne Endophytic Community with Novel Bacterial Species such as *Rhizobium endophyticum* sp. nov.," Systematic Appl Microbiol., 2010, pp. 322-327, vol. 33.
Lorck, H., "Production of Hydrocyanic Acid by Bacteria," Physiol Plant, 1948, pp. 142-146, vol. 1.
Lugtenberg, B., et al., "Plant-Growth-Promoting Rhizobacteria," Ann. Rev. Microbiol., 2009, pp. 541-556, vol. 63.
Lundberg, D.S., et al., "Defining the Core *Arabidopsis thaliana* Root Microbiome," Nature, 2012, pp. 86-90, vol. 488, No. 7409.
Lundberg, D.S., et al., "Practical Innovations for High-Throughput Amplicon Sequencing," Nat Methods, 2013, pp. 999-1002, vol. 10, No. 10.
Ma, Y., et al., "Plant Growth Promoting Rhizobacteria and Endophytes Accelerate Phytoremediation of Metalliferous Soils," Biotechnology Advances, 2011, pp. 248-258, vol. 29.
Madi, L. et al., "Aggregation in Azospirillum brasilense Cd: Conditions and Factors Involved in Cell-to-Cell Adhesion," Plant Soil, 1989, pp. 89-98, vol. 115.
Mandyam, K., et al., "Mutualism-parasitism paradigm synthesized from results of root-endophyte models", Frontiers in Microbiology, vol. 5, Jan. 12, 2015, pp. 1-14.
Mannisto, M.K., et al., "Characterization of Psychrotolerant Heterotrophic Bacteria From Finnish Lapland," Syst Appl Microbiol., 2006, pp. 229-243, vol. 29.
Mano, H., et al., "Culturable Surface and Endophytic Bacterial Flora of the Maturing Seeds of Rice Plants (*Oryza saliva*) Cultivated in a Paddy Field," Microbes Environ., 2006, vol. 21, No. 2.
Manoharan, M. J. et. al., "Survival of flocculated cells in alginate and its inoculatin effect on growth and yield of maize underwater deficit conditions," EP J of Soil Biology, Gauthier-Villars, Montrouge, FR, vol. 50, Mar. 7, 2012, pp. 198-206, XP028421147.
Manter, D. K., et al., "Use of the ITS Primers, ITSIF and ITS4, to Characterize Fungal Abundance and Diversity in Mixed-Template Samples by qPCR and Length Heterogeneity Analysis," J Microbiol Methods, 2007, pp. 7-14, vol. 71.
Mao, W., et al., "Seed Treatment with a Fungal or a Bacterial Antagonist for Reducing Corn Damping-off Caused by Species of *Pythium* and *Fusarium*," Plant Disease, 1997, pp. 450-454, vol. 81, No. 5.
Marasco, R., et al., "A Drought Resistance-Promoting Microbiome is Selected by Root System Under Desert Farming," PLoS ONE, 2012, vol. 7, No. 10, 14 Pages.
Marquez, L. M., et al., "A Virus in a Fungus in a Plant: Three-Way Symbiosis Required for Thermal Tolerance," Science, 2007, pp. 513-515, vol. 315.
Mastretta, C., et al., "Endophytic Bacteria from Seeds of Nicotiana Tabacum Can Reduce Cadmium Phytotoxicity," Intl J Phytoremediation, 2009, pp. 251-267, vol. 11.
Mateos, P. F., et al., "Cell-Associated Pectinolytic and Cellulolytic Enzymes in Rhizobium leguminosarum biovartrifolii," Appl Environ Microbiol., 1992, pp. 816-1822, vol. 58, No. 6.
Mcdonald, D., et al., "An Improved Greengenes Taxonomy with Explicit Ranks for Ecological and Evolutionary Analyses of Bacteria and Archaea," ISME J., 2012, pp. 610-618, vol. 6.
Mcguire, K.L., et al., "Digging the New York City Skyline: Soil Fungal Communities in Green Roofs and City Parks," PloS One, 2013, vol. 8, No. 3, 13 Pages.
Medina, P., et al., "Rapid Identification of Gelatin and Casein Hydrolysis Using TCA," J Microbiol Methods, 2007, pp. 391-393, vol. 69.
Mehnaz, S., et al., "Growth Promoting Effects of Corn (*Zea mays*) Bacterial Isolates Under Greenhouse and Field Conditions," Soil Biology and Biochemistry, 2010, pp. 1848-1856, vol. 42.

(56) References Cited

OTHER PUBLICATIONS

Mehnaz, S., et al., "Isolation and 16S rRNA sequence analysis of the beneficial bacteria from the rhizosphere of rice," Canada Journal of Microbiology, 2001, pp. 110-117, vol. 47, No. 2.
Mei, C., et al., "The Use of Beneficial Microbial Endophytes for Plant Biomass and Stress Tolerance Improvement," Recent Patents on Biotechnology, 2010, pp. 81-95, vol. 4.
Michel, B. E., et al., "The Osmotic Potential of Polyethylene Glycol 6000," Plant Physiol., 1973, pp. 914-916, vol. 51.
Misk, A., et al., "Biocontrol of chickpea root rot using endophytic actinobacteria", Biocontrol, vol. 56, No. 5, Mar. 12, 2011, pp. 811-822, XP036215297.
Miyoshi-Akiyama, T., et al., "Multilocus Sequence Typing (MLST) for Characterization of Enterobacter cloacae," PLoS ONE, 2013, vol. 8, No. 6, 10 Pages, e66358.
Moe, L. A., "Amino Acids in the Rhizosphere: From Plants to Microbes," American Journal of Botany, 2013, pp. 1692-1705, vol. 100, No. 9.
Mohiddin, F. A., et al., "Tolerance of Fungal and Bacterial Biocontrol Agents to Six Pesticides Commonly Used in the Control of Soil Borne Plant Pathogens," African Journal of Agricultural Research, 2013, pp. 5331-5334, vol. 8, No. 13.
Mousa, W. K., et al., "The Diversity of Anti-Microbial Secondary Metabolites Produced by Fungal Endophytes: An Interdisciplinary Perspective," Front Microbiol., 2013, vol. 4, No. 65, 18 Pages.
Mundt, J.O., et al., "Bacteria Within Ovules and Seeds," Appl Environ Microbiol., 1976, pp. 694-698, vol. 32, No. 5.
Naik, B. S., et al., "Study on the diversity of endophytic communities from rice (*Oryza sativa* L.) and their antagonistic activities in vitro," Microbiological Research, 2009, pp. 290-296, vol. 164.
Nassar, A., et al., "Promotion of plant growth by an auxin-producing isolate of the yeast *Williopsis saturnus* endophytic in maize (*Zea mays* L.) roots", Biology and Fertility of Soils; Cooperating Journal of International Society of Soil Science, Springer, Berlin, DE, vol. 42, No. 2, Nov. 1, 2005, pp. 97-108.
Naveed, M., "Maize Endophytes—Diversity, Functionality and Application Potential," University of Natural Resources and Life Sciences, 2013, pp. 1-266 and 81-87; Tables 1-3; Figure 2.
Nejad, P. et al., "Endophytic Bacteria Induce Growth Promotion and Wilt Disease Suppression in Oilseed Rape and Tomato," Biological Control, 2000, pp. 208-215, vol. 18.
Neslon, E.B., "Microbial Dynamics and Interactions in the Spermosphere," Ann. Rev. Phytopathol., 2004, pp. 271-309, vol. 42.
Nikolcheva, L.G., et al., "Taxon-Specific Fungal Primers Reveal Unexpectedly High Diversity During Leaf Decomposition in a Stream," Mycological Progress, 2004, pp. 41-49, vol. 3, No. 1.
Murali, Gopal, et al., "Microbiome Selection Could Spur Next-Generation Plant Breeding Strategies," Frontiers in Microbiology, vol. 7, Dec. 7, 2016, XP055531064.
Nimnoi, P., et al., "Co-Inoculation of Soybean (*Glycin max*) wtth Actinomycetes and Bradyrhizobium Japonicum Enhances Plant Growth, Nitrogenase Activity and Plant Nutrition," Journal of Plant Nutrition, 2014, pp. 432-446, vol. 37.
Nishijima, K.A., et al., "Demonstraling Pathogenicity of Enterobacter cloacae on Macadamia and Identifying Associated Volatiles of Gray Kernel of Macadamia in Hawaii," Plant Disease, Oct. 2007, vol. 91, No. 10, pp. 1221-1228.
Shapiro-Ilan, D.I., et al., "The Potential for Enhanced Fungicide Resistance in Beauveria Bassiana Through Strain Discovery and Artificial Selection," Journal of Invertebrate Pathology, 2002, pp. 86-93, vol. 81.
Shankar, M., et al.,"Root colonization of a rice growth promoting strain of Enterobacter cloacae," Journal of Basic Microbiology, 2011, pp. 523-530, vol. 51.
Sharma et al., "Detection and identification of bacteria intimately associated with fungi of the order Sebacinales", Cellular Microbiology, Aug. 5, 2008, pp. 2235-2246, vol. 10, No. 11.
Shiraishi, A., et al., "Nodulation in black locust by the ammaproteobacteria *Pseudomonas* sp. and the Betaproteobacteria *Burkholderia* sp", Systematic and Applied Microbiology, vol. 33, No. 5, Aug. 2010, pp. 269-274.
Simola, L., et al., "The Effect of Some Protein and Non-Protein Amino Acids on the Growth of Cladosporium herbarum and Trichotheeium roseum," Effect of Amino Acids on Fungi, Physiologia Plantarum, 1979, vol. 46, pp. 381-387.
Singh, A K., et al., "Uncultured *Actinomyces* sp. Clone EMLACT 80 IV (New) 16S Ribosomal RNA Gene, Partial Sequence," NCBI GenBank Accession No. JQ285908. Submitted Dec. 13, 2011, 1 page.
Soares, M. M. C. N., et al., "Screening of Bacterial Strains for Pectinolytic Activity: Characterization of the Polygalacturonase Produced by *Bacillus* SP," Revista de Microbiolgia, 1999, pp. 299-303, vol. 30.
Soe, K.M., et al., "Effects of endophytic actinomycetes and Bradyrhizobium japonicum strains on growth, nodulation, nitrogen fixation and seed weight of different soybean varieties," Soil Science and Plant Nutrition, 2012, pp. 319-325, vol. 58, No. 3.
Soe, K.M., et al., "Low-Density Co-Inoculation of Myanmar Bradyrhizobium yuanmingense MAS34 and Streptomyces griseoflavus P4 to Enhance Symbiosis and Seed Yield in Soybean Varieties," American Journal of Plant Sciences, 2013, pp. 1879-1892, vol. 4.
Sogonov, M.V., et al., "The hyphomycete *Teberdinia hygrophila* gen. nov., sp. nov. and related anamorphs of *Pseudeurotium* species," Mycologia, May 2005, pp. 695-709, vol. 97, No. 3.
Song, M., et al., "Effects of Neotyphodium Endophyte on Genmination of Hordeum brevisubulatum under Temperature and Water Stress Conditions," Acta Agrestia Sinica, 2010, pp. 834-837, vol. 18, No. 6. (English Abstract).
Souleimanov, A., et al., "The Major Nod Factor of Bradyrhizobium japonicum Promotes Early Growth of Soybean and Corn," J. Exp. Bot., 2002, pp. 1929-1934, vol. 53, No. 376.
Spiekermann, P., et al., "A Sensitive, Viable-Colony Staining Method Using Nile Red for Direct Screening of Bacteria that Accumulate Polyhydroxyalkanoic Acids and Other Lipid Storage Compounds," Arch Microbiol., 1999, pp. 73-80, vol. 171.
Staudt, A. K., et al., "Variations in Exopolysaccharide Production by Rhizobium tropici," Arch Microbiol., 2012, pp. 197-206, vol. 194.
Stielow, J.B., et al., "One fungus, which genes? Development and assessment of universal primers for potential secondary fungal DNA barcodes," Persoonia: Molecular Phylogeny and Evolution of Fungi, 2015, vol. 35, pp. 242-263.
Strobel, G. A., "Endophytes as Sources of Bioactive Products," Microbes and Infection, 2003, pp. 535-544, vol. 5.
Sturz, A. V., et al., "Weeds as a Source of Plant Growth Promoting Rhizobacteria in Agricultural Soils," Can J Microbiol., 2001, pp. 1013-1024, vol. 47, No. 11.
Surette, M.A., et al. "Bacterial Endophytes in Processing Carrots (*Daucus carota* L. var. *sativus*): Their Localization, Population Density, Biodiversity and Their Effects on Plant Growth," Plant and Soil, 2003, pp. 381-390, vol. 253, No. 2.
Suto, M., et al., "Endophytes as Producers of Xylanase," J Biosci Bioeng., 2002, pp. 88-90, vol. 93, No. 1.
Sword, G., "Manipulating Fungal Endophytes to Protect Plants from Insects and Nematodes," Power Point Presentation dated Aug. 7, 2013, 48 Pages.
Sword, G., et al., "Field Trials of Potentially Beneficial Fungal Endophytes in Cotton," Power Point Presentation dated Jan. 7, 2013, 17 Pages.
Sword, G., "Fungal Endophytes to Protect Cotton from Insects and Nematodes," Power Point Presentation dated Dec. 7, 2012, 20 Pages.
Sword, G., "Natural Enemies—The Forgotten Basis of IPM?," Power Point Presentation dated Sep. 6, 2013, 33 Pages.
Taghavi, S., et al., "Genome Survey and Characterization of Endophytic Bacteria Exhibiting a Beneficial Effect on Growth and Development of Poplar Trees," Applied and Environmental Microbiology, 2009, pp. 748-757, vol. 75, No. 3.
Taghavi, S., et al., "Genome Sequence of the Plant Growth promoting Endophytic Bacterium *Enterobacter* sp. 638", PLoS Genet., May 2010, vol. 6, Issue 5, e1000943, pp. 1-15.

(56) References Cited

OTHER PUBLICATIONS

Tamura, K., et al., "Estimation of the number of nucleotide substitutions in the control region of mitochondrial DNA in humans and chimpanzees," Molecular Biology and Evolution, 1993, vol. 10, No. 3, pp. 512-526.
Taylor, A.G., et al., "Concepts and Technologies of Selected Seed Treatments," Annu. Rev. Phytopathol., 1990, pp. 321-339, vol. 28.
Leather, R. M., et al., "Use of Congo Red-Polysaccharide Interactions in Enumeration and Characterization of Cellulolytic Bacteria from the Bovine Rumen," Appl Environ Microbiol., 1982, pp. 777-780, vol. 43, No. 4.
Thakur, A., et al., "Detrimental effects of endophytic fungus *Nigrospora* sp. on survival and development of Spodoptera litura," Biocontrol Science and Technology, Feb. 1, 2012, pp. 151-161, vol. 22, No. 2.
Thakur, A., et al., "Enhanced Resistance to Spodoptera litura in Endophyte Infected Cauliflower Plants," Environmental Entomology, Apr. 1, 2013, pp. 240-246, vol. 42, No. 2.
Thakur, A., et al., "Suppression of Cellular Immune Response in Spodoptera litura (Lepidoptera: Noctuidae) Larvae by Endophytic Fungi Nigrospora oryzae and Cladosporium uredinicola,", Annals of the Entomological Society of America, May 1, 2014, pp. 674-679, vol. 107, No. 3.
Thomas, L., et al., "Development of Resistance to Chlorhexidine Diacetate in Pseudomonas aeruginosa and the Effect of a "Residual" Concentration," J Hosp Infect., 2000, pp. 297-303, vol. 46.
Thomashow, M. F., "So What's New in the Field of Plant Cold Acclimation? Lots!," Plant Physiol., 2001, pp. 89-93, vol. 125.
Tokala, R. T., et al., "Novel Plant-Microbe Rhizosphere Interaction Involving Streptomyces Lydicus WYEC108 and the Pea Plant (*Pisum sativum*)," Applied and Environmental Microbiology, May 2002, pp. 2161-2171, vol. 68, No. 5.
Trotel-Aziz, P., et al., "Characterization of New Bacterial Biocontrol Agents Acinetobacter, *Bacillus, Pantoea* and *Pseudomonas* spp. Mediating Grapevine Resistance Against Botrytis cinerea," Environmental and Experimental Botany, 2008, pp. 21-32, vol. 64.
Truyens, S., et al., "Changes in the Population of Seed Bacteria of Transgenerationally Cd-Exposed *Arabidopsis thaliana*," Plant Biol., 2013, pp. 971-981, vol. 15.
U'ren, J.M., et al., "Host and geographic structure of endophytic and endolichenic fungi at the continental scale," American Journal of Botany, May 1, 2012, pp. 898-914, vol. 99, No. 5.
Usadel, B., et al., "The Plant Transcriptome—From Integrating Observations to Models," Front Plant Sci., 2013, pp. 1-3, vol. 4., Article 48, 3 Pages.
Vacheron, J., et al., "Plant Growth-Promoting Rhizobacteria and Root System Functioning," Frontiers Plant Sci., 2013, vol. 4, Article 356, 19 Pages.
Valencia, C. U., et al., "Endophytic Establishment as an Unintended Consequence of Biocontrol with Fungal Entomopathogens," Power Point Presentation dated Jan. 7, 2013, 10 Pages.
Valencia, E., et al., "Mini-review: Brazilian fungi diversity for biomass degradation," Fungal Genetics and Biology, 2013, pp. 9-18, vol. 60.
Van Der Lelie, D., et al., "Poplar and its Bacterial Endophytes: Coexistence and Harmony," Critical Rev Plant Sci., 2009, pp. 346-358, vol. 28.
Verkley, G., et al., "Paraconiothyrium, a new genus to accommodate the mycoparasite Coniothyrium minitans, anamorphs of Paraphaeosphaeria, and four new species," Studies in Mycology, 2004,; pp. 323-335, vol. 50.
Vining, K., et al., "Methylome Reorganization During in vitro Dedifferentiation and Regeneration of Populus trichocarpa," BMC Plant Biol., 2013, vol. 13, No. 92, 15 Pages.
Viruel, E., et al., "Pseudomonas thiveralensis Strain IEHa 16S Ribosomal RNA Gene, Partial Sequence," NCBI GenBankAccession No. GQ169380.1, Submitted May 15, 2009, 1 Page.
Visagie, C.M., et al., "Identification and nomenclature of the genus *Penicillium*," Studies in Mycology, Jun. 2014, pp. 343-371, vol. 78.

Vujanovic, V., et al., "Viability Testing of Orchid Seed and the Promotion of Colouration and Germination," Annals of Botany, Mar. 17, 2000, pp. 79-86, vol. 86.
Vujanovic, V., et al., "Endophytic hyphal compartmentalization is required for successful mycobiont-wheat interaction as revealed by confocal laser microscopy," The proceedings of the Soils and Crops conference in Saskatoon (2008) published 2009, 7 Pages.
Vujanovic, V., et al., "A comparative study of endophytic mycobiota in leaves of Acer saccharum in eastern North America," Mycological Progress, May 2002, pp. 147-154, vol. 1, Issue 2.
Vujanovic, V., et al.,"Orchid seed viability testing by fungal bioassays and molecular phylogeny," Floriculture, ornamental and plant biotechnology, 2006, vol. 63, pp. 563-569.
United States Patent Office, Non-Final Office Action, U.S. Appl. No. 14/766,065, dated Oct. 27, 2017, 11 Pages.
United States Patent Office, Non-Final Office Action, U.S. Appl. No. 14/964,429, dated Aug. 9, 2016, 6 Pages.
United States Patent Office, Final Office Action, U.S. Appl. No. 14/964,429, dated May 31, 2017, 9 Pages.
United States Patent Office, Non-Final Office Action, U.S. Appl. No. 15/212,038, dated Sep. 21, 2016, 10 Pages.
United States Patent Office, Non-Final Office Action, U.S. Appl. No. 15/063,350, dated Nov. 10, 2016, 18 Pages.
United States Patent Office, Final Office Action, U.S. Appl. No. 14/614,193, dated Dec. 22, 2016, 13 Pages.
United States Patent Office, Final Office Action, U.S. Appl. No. 14/614,193, dated Jul. 18, 2017, 14 Pages.
United States Patent Office, Final Office Action, U.S. Appl. No. 14/614,193, dated May 3, 2018, 10 Pages.
United States Patent Office, Non-Final Office Action, U.S. Appl. No. 15/107,973, dated Apr. 10, 2017, 39 Pages.
United States Patent Office, Final Office Action, U.S. Appl. No. 15/107,973, dated Jan. 26, 2018, 20 Pages.
United States Patent Office, Final Office Action, U.S. Appl. No. 14/410,537, dated May 5, 2017, 9 Pages.
United States Patent Office, Non-Final Office Action, U.S. Appl. No. 15/034,862, dated May 19, 2017, 8 Pages.
United States Patent Office, Final Office Action, U.S. Appl. No. 15/034,862, dated Jan. 12, 2018, 14 Pages.
United States Patent Office, Non-Final Office Action, U.S. Appl. No. 15/436,592, dated Aug. 30, 2017, 17 Pages.
United States Patent Office, Non-Final Office Action, U.S. Appl. No. 15/436,609, dated Aug. 30, 2017, 21 Pages.
United States Patent Office, Non-Final Office Action, No. U.S. Appl. No. 14/916,514, dated Sep. 20, 2017, 31 Pages.
United States Patent Office, Non-Final Office Action, U.S. Appl. No. 15/143,398, dated Sep. 22, 2017, 17 Pages.
United States Patent Office, Non-Final Office Action, U.S. Appl. No. 15/143,394, dated Sep. 25, 2017, 15 Pages.
United States Patent Office, Non-Final Office Action, U.S. Appl. No. 15/107,965, dated Jun. 21, 2018, 27 Pages.
Abarenkov, K., et al., "The Unite Database for Molecular Identification of Fungi-Recent Updates and Future Perspectives," New Phytol., 2010, pp. 281-285, vol. 186.
Abdellatif, L., et al., "Endophytic hyphal compartmentalization is required for successful symbiotic Ascomycota association with root cells," Mycological Research, 2009, pp. 782-791, vol. 113.
Abdellatif, L., et al., "Characterization of virulence and PCR-DGGE profiles of Fusarium avenaceum from western Canadian Prairie Ecozone of Saskatchewan," Canadian Journal of Plant Pathology, 2010, pp. 468-480.
Abello, J., et al., "Agrobacterium-mediated transformation of the endophytic fungus *Acremonium implicatum* associated with Brachiaria grasses", Mycological Research, pp. 407-413, vol. 112, Pt 3.
Abdou, R., et al., "Botryorhodines A-D, antifungal and cytotoxic depsidones from Botryosphaeria rhodina, an endophyte of the medicinal plant Bidens pilosa," Phytochemistry, 2010, vol. 71, pp. 110-116.
Abou-Shanab, R.A., et al: "Characterization of Ni-resistant bacteria in the rhizosphere of the hyperaccumulator Alyssum murale by 16S rRNA gene sequence analysis", World Journal of Microbiology and Biotechnology, vol. 26, No. 1, Aug. 15, 2009, pp. 101-108.

(56) References Cited

OTHER PUBLICATIONS

Adhikari, M., et al., "A New Record of Pseudeurotium bakeri from Crop Field Soil in Korea," The Korean Journal of Mycology, 2016, pp. 145-149, vol. 44.

Ahmad, F., et al., "Screening of Free-Living Rhizospheric Bacteria for Their Multiple Plant Growth Promotinq Activities," Microbiol Res., 2008, pp. 173-181, vol. 163.

Al-Askar AA, "Microbiological studies on the in vitro inhibitory effect of Streptomyces collinus albescens against some phytopathogenic fungi", African Journal of Microbiology Research, 2012, 6: 3277-3283 & GenBank Accession No. AB184101, May 20, 2008.

Amann, R., et al., "The Identification of Microorganisms by Fluorescence in Situ Hybridisation," Curr Opin Biotechnol., 2001, pp. 231-236, vol. 12.

Amatuzzi, R.F., et al., "Universidade Federal do Parana," Jan. 1, 2014, 52 Pages. (With English Abstract).

Amatuzzi, R.F., et al., "Potential of endophytic fungi as biocontrol agents of Duponchelia fovealis (Zeller) (Lepidoptera:Crambidae," Brazilian Journal of Biology, Nov. 9, 2017, 7 Pages.

Antony-Badu, S., et al., "Multiple *Streptomyces* species with distinct secondary metabolomes have identical 16S rRNA gene sequences." Scientific Reports 7.1, Sep. 2017, No. 7, 11089, pp. 1-8.

Apel, K., et al., "Reactive Oxygen Species: Metabolism, Oxidative Stress, and Signal Transduction," Annu Rev Plant Biol., 2004, pp. 373-399, vol. 55.

Ardakani, M.R. et al., "Absorption of N, P, K thorugh triple inoculation of wheat (*Triticum aestivum* L.) by Azospirillum brasilense, *Streptomyces* sp., Glomus intraradices and manure application," Physiol Mol Biol Plants, 2011, vol. 17, No. 2, pp. 181-192.

Arendt, K. R., et al., "Isolation of endohyphal bacteria from foliar Ascomycota and in vitro establishment of their symbiotic associations," Appl Environ. Microbiol., 2016, pp. 2943-2949, vol. 82, No. 10.

Artursson, V., et al., "Interactions between arbuscular mycorrhizal fungi and bacteria and their potential for stimulating plant growth", Environmental Microbiology, vol. 8, No. 1, Jan. 1, 2006, pp. 1-10.

Ashrafuzzaman, M., et al., "Efficiency of plant growth-promoting rhizobacteria (PGPR) for the enhancement of rice growth," African Journal of Biotechnology, 2009, pp. 1247-1252, vol. 8, No. 7.

Aveskamp, M., et al., "DNA phylogeny reveals polyphyly of Phoma section Peyronellaea and multiple taxonomic novelties," Mycologia, 2009, vol. 101, No. 3, pp. 363-382.

Azcon, R., et al., "Selective interactions between different species of mycorrhizal fungi and Rhizobium meliloti strains, and their effects on growth, N2-fixation (15N) and nutrition of Medicago sativa L.," NewPhytol., 1991, vol. 117, pp. 399-404.

Bacon, C. W, et al., "Isolation, In Planta Detection, and Uses of Endophytic Bacteria for Plant Protection," Manual of Environmental Microbiology, 2007, pp. 638-647.

Baker, K. F., et al., "Dynamics of Seed Transmission of Plant Pathogens," Annu Rev. Phytopathol., 1966, pp. 311-334, vol. 4.

Baltruschat, H., et al., "Salt tolerance of barley induced by the root endophyte Piriformospora indica is associated with a strong increase in antioxidants," New Phytologist., 2008, pp. 501-510, vol. 180.

Bandara, WM.M.S., et al., "Interactions among endophytic bacteria and fungi: effects and potentials" Journal of Biosciences, Dec. 2006, vol. 31, No. 5, pp. 645-650.

Barnett, S., et al., "Selection of microbes for control of Rhizoctonia root rot on wheat using a high throughput pathosystem", Biological Control, Jul. 6, 2017, 113: 45-57.

Bashan, Yoav Ed, et al., "Inoculants of plant growth-promoting bacteria for use in agriculture," Biotechnology Advances, Elsevier Publishing, Barking, GB, vol. 16, No. 4, Jul. 1, 1998, pp. 729-770, XP004123985.

Bashan, Yoav E., et al., "Alginate Beads as Synthetic Inoculant Carriers for Slow Release of Bacteria that Affect Plant Growth," Applied and Environmental Microbiology, pp. 1089-1098, May 1986.

Bensch, K., et al., "Species and ecological diversity within the Cladosporium cladosporioides complex (Davidiellaceae, Capnodiales)," Studies in Mycology, 2010, pp. 1-94, vol. 67.

Bethlenfalvay, G., et al., "Mycorrhizal fungi effects on nutrient composition and yield of soybean seeds", Journal of Plant Nutrition, vol. 20, pp. 4-5, Apr. 1, 1997, pp. 581-591.

Bing, LA, et al., "Suppression of Ostrinia nubilalis (Hübner) (Lepidoptera: Pyralidae) by endophytic Beauveria bassiana (Balsamo) Vuillemin", Environmental Entomol, Entomological Society of America, College Park, MD, US, vol. 20, Jan. 1, 1991, pp. 1207-1211.

Block, C. C., et al., "Seed Transmission of Pantoea stewartii in Field and Sweet Corn," Plant Disease, 1998, pp. 775-780, vol. 82.

Fiehn, O., et al., "Metabolite Profiling for Plant Functional Genomics," Nature Biotechnol., 2000, pp. 1157-1161, vol. 8.

Fierer, N., et al., "Cross-Biome Metagenomic Analyses of Soil Microbiol Communities and Their Functional Attributes," Proc Natl Acad Sci USA, 2012, pp. 21390-21395, vol. 109, No. 52.

Fincher, G. B., "Molecular and Cellular Biology Associated with Endosperm Mobilization in Germinating Cereal Grains," Annu Rev Plant Physiol Plant Mol Biol., 1989, pp. 305-346, vol. 40.

Fisher, P. J., et al., "Fungal saprobes and pathogens as endophytes of rice (*Oryza sativa* L.)," New Phytol., 1992, pp. 137-143, vol. 120.

Fisher, P.R., et al., "Isolation and Characterization of the Pesticide-Degrading Plasmid pJP1 from Alcaligenes paradoxus," J Bacteriol., 1978, pp. 798-804, vol. 135, No. 3.

Fox, G., et al., "How close is close: 16S rRNA sequence identity may not be sufficient to guarantee species identity." International Journal of Systematic and Evolutionary Microbiology 42.1, 1992, pp. 166-170.

Franco, C., et al., "Actinobacterial Endophytes for Improved Crop Performance," Australasian Plant Pathology, 2007, pp. 524-531, vol. 36.

Fulthorpe, R. R., et al., "Distantly Sampled Soils Carry Few Species in Common," ISME J., 2008, pp. 901-910, vol. 2.

Gantner, S., et al., "Novel Primers for 16S rRNA-based Archaeal Community Analyses in Environmental Samples," J Microbiol Methods, 2011, pp. 12-18, vol. 84.

Gao, Z., et al., "Quantitation of Major Human Cutaneous Bacterial and Fungal Populations," J Clin Microbiol., 2010, pp. 3575-3581, vol. 48, No. 10.

Garazzino, S., et al., "Osteomyelitis Caused by Enterobacter cancerogenus Infection following a Traumatic Injury Case Report and Review of the Literature," J Clin Microbiol., Mar. 2005, vol. 43, No. 3, pp. 1459-1461.

Gasser, I., et al., "Ecology and Characterization of Polyhydroxyalkanoate-Producing Microorganisms on and in Plants," FEMS Microbiol Ecol., 2010, pp. 142-150, vol. 70.

Gavrish, E, et al., "*Lentzea* sp. MS6 16S Ribosomal RNA Gene, Partial Sequence," NCBI GenBank Accession No. EF599958. Submitted May 9, 2007, 1 Page.

Gebhardt, J., et al., "Characterization of a single soybean cDNA encoding cytosolic and glyoxysomal isozymes of aspartate aminostransferase," Plant Molecular Biology, 1998, pp. 99-108, vol. 37.

GenBank: AF034210.1 "Glycine max aspartate aminotransferase glyoxysomal isozyme AAT1 precursor and aspartate aminotransferase cytosolic isozyme AAT2 (AAT) mRNA, complete eds," NCBI, May 26, 1998, 2 Pages, can be retrieved at <URL:https://www.ncbi.nlm.nih.gov/nuccore/AF034210>.

GenBank: JN210900.1, "*Enterobacter* sp. WS05 16S ribosomal RNA gene, partial sequence," NCBI, Sep. 24, 2012, 1 Page, can be retrieved at<URL:https://www.ncbi.nlm.nih.gov/nuccore/jn210900>.

GenBank: NP_001237541.1, "aspartate aminotransferase glyoxysomal isozyme AAT1 precursor [Glycine max]," NCBI, Oct. 29, 2016, 2 Pages, can be retrieved at <URL:https://www.ncbi.nlm.nih.gov/protein/NP_001237541.1 >.

NCBI GenBank: CP000653.1 "*Enterobacter* sp. 638, complete genome" Jan. 28, 2014, 5 Pages, Can be retrieved at<URL:https://www.ncbi.nlm.nih.gov/nuccore/CP000653.1>.

(56) References Cited

OTHER PUBLICATIONS

NCBI GenBank: CP000653.1 "*Enterobacter* sp. 638, complete genome" ASM1632v1, Apr. 18, 2007, 2 Pages, Can be retrieved at <URL:https://www.ncbi.nlm.nih.gov/assembly/GCA000016325.1>.
NCBI GenBank: EU340965.1 "*Enterobacter* sp. 638 16S ribosomal RNA gene, partial sequence" Jan. 30, 2009, 1 Page, Can be retrieved at <URL:https://www.ncbi.nlm.nih.gov/nuccore/EU340965.1>.
NCBI GenBank: EBI accession No. EM STD:JQ759988, "*Dothideomycetes* sp. genotype 226 isolate FL0175 internal transcribed spacer 1, partial sequence; 5.8S ribosomal RNA gene and internal transcribed spacer 2, complete sequence; and 28S ribosomal RNA gene, partial sequence," May 17, 2012, 2 Pages.
NCBI GenBank: EBI accession No. EM STD:GU055658, "Uncultured Periconia clone NG R 806 18S ribosomal RNA gene, partial sequence; internal transcribed spacer 1, 5.8S ribosomal RNA gene, and internal transcribed spacer 2, complete sequence; and 28S ribosomal RNA gene, partial sequence," Oct. 27, 2009, 2 Pages.
NCBI GenBank: Accession No. JX880250.1, "Enterobacteriaceae bacterium Clero1 16S ribosomal RNA gene, partial sequence," NIH, Jun. 24, 2015, 2 Pages, can be retrieved at <URL:https://www.ncbi.nlm.nih.gov/nucleotide/JX880250.1?report=genbank&log$=nuclalign&blast_rank=80 &RID=KWUPBV08015>.
GenBank Accession No. KY643705, Feb. 27, 2017.
GenBank Accession No. KF951483, Jan. 5, 2014.
GenBank Accession No. KJ152029, May 6, 2015.
GenBank Accession No. KJ162248, Apr. 8, 2014.
GenEmbl Database, GenEmbl Record No. KF673660, Sandberg, et al., "Fungal endophytes of aquatic macrophytes: diverse host-generalists characterized by tissue preferences and geographic structure," 2013, 35 Pages.
GenEmbl Database, GenEmbl Record No. KP991588, Huang, et al., "Pervasive effects of wildfire on foliar endophyte communities in montane forest trees," Mar. 2015, 35 Pages.
GenEmbl database, GenEmbl Record No. EU 977189, Jan. 21, 2009, 4 pages, Smith, S.A., et al., "Bioactive endophytes warrant intensified exploration and conservation," PloS ONE 3(8):E3052, 2008.
GenEmbl database, GenEmbl Record No. KF011597, Paenibacillus strain No. HA 13, Aug. 26, 2013, 5 Pages, Park, H.J., et al., "Isolation and characterization of humic substances-degrading bacteria from the subarctic Alaska grasslands," J Basic Microbiol, 2013.
Database Geneseq Database accession No. BAP97938 "Pantoea dispersa strain KACC91642P 16S rDNA sequence, Seq ID 1." Aug. 15, 2013, 1 Page.
Database Embl [Online] Oct. 1, 2001, 2 Pages, "Setosphaeria monoceras 28S ribosomal RNA gene, partial sequence," XP002777918, retrieved from EBI accession No. EM_STD:AY016368 Database accession; No. AY016368 sequence.
NCBI, GenBankAccession No. XP_002568042, Aug. 14, 2009, 4 Pages, Berg, V.D., et al., "Genome sequencing and analysis of the filamentous fungus," Nat. Biotechnol. 26 (10), 1161-1168 (2008).
Gilmour, S. J., et al., "Overexpression of the *Arabidopsis* CBF3 Transcriptional Activator Mimics Multiple Biochemical Changes Associated with Cold Acclimation," Plant Physiol., 2000, pp. 1854-1865, vol. 124.
Giraldo, A., et al., "Phylogeny of Sarocladium (Hypocreales)," Persoonia, 2015, pp. 10-24, vol. 34.
Gitaitis, R., et al., "The Epidemiology and Management of Seedborne Bacterial Diseases," Annu Rev Phytopathol., 2007, pp. 371-397, vol. 45.
Goudjal, Y., et al., "Biocontrol of Rhizoctonia solani damping-off and promotion of tomato plant growth by endophytic actinomycetes isolated from native plants of Algerian Sahara", Microbiological Research, 2014, vol. 169, No. 1, pp. 59-65.
Govindarajan, M. et al., "Effects of the Inoculation of Burkholderia vietnamensis and Related Endophytic Diaztrophic Bacteria on Grain Yield of Rice", Microbiol Ecology, Apr. 4, 2007, 17 Pages.

Grondona, I., et al., "Tusal®, a commercial biocontrol formulation based on Trichoderma," Bulletin OILB/SROP, 2004, pp. 285-288, vol. 27, No. 8.
Gu, O., et al., "*Glycomyces sambucus* sp. nov., an endophytic actinomycete islolated from the stem of Sambucus adnata Wall," International Journal of Systematic and Evolutionary Microbiology, 2007, pp. 1995-1998, vol. 57.
Guo, X., et al., "Red Soils Harbor Diverse Culturable Actinomycetes That Are Promising Sources of Novel Secondary Metabolites", Applied and Environmental Microbiology, Feb. 27, 2015, vol. 81, No. 9, pp. 3086-3103.
Haake, V., et al., "Transcription Factor CBF4 is a Regulator of Drought Adaptation in *Arabidopsis*," Plant Physiol., 2002, pp. 639-648, vol. 130.
Haas, D., et al., "R Factor Variants with Enhanced Sex Factor Activity in Pseudomonas aeruginosa," Mol Gen Genet., 1976, pp. 243-251, vol. 144.
Hahm, M-S., et al., "Biological Control and Plant Growth Promoting Capacity of Rhizobacteria and Pepper Under Greenhouse and Field Conditions," The Journal of Microbiology, The Microbiological Society of Korea, Heidelberg, Jun. 30, 2012, pp. 380-385, vol. 50, No. 3.
Hain, T., et al., "Chitinolytic transgenes from Streptomyces albidoflavus as phytochemicals defences against; herbivorous insects, use in transgenic plants and effect in plant development", International Journal of Systematic Bacteriology, Jan. 1997, vol. 47, No. 1, pp. 202-206.
Hallman, J., et al., "Bacterial Endophytes in Agricultural Crops," Canadian J Microbiol., 1997, pp. 895-914, vol. 13.
Hamayun, M., et al., "Cladosporium sphaerospermum as a new plant growth-promoting endophyte from the roots of Glycine max (L.) Merr," World Journal of Microbiology and Biotechnology, Kluwer Academic Publishers, DO, vol. 25, No. 4, Feb. 15, 2009 (Feb. 15, 2009), pp. 627-632.
Hanshew, A., et al., "Characterization of Actinobacteria Associated with Three Ant-Plant Mutualisms", Microbiol Ecology, Aug. 6, 2014, vol. 69, No. 1, pp. 192-203.
Hanson, L.E., "Reduction of Verticillium Wilt Symptoms in Cotton Following Seed Treatment with Trichoderma virens," The Journal of Cotton Science, 2000, pp. 224-231, vol. 4, No. 4.
Hamayun, M., et al., "Gibberellin production and plant growth promotion from pure cultures of *Cladosporium* sp. MH-6 isolated from cucumber (*Cucumis sativus* L.)", Mycologia, 102 (5), 2010, pp. 989-995.
Shupeng, T., et al. "Advances in Study of Interactions between Mycorrhizal Fungi and Bacteria", Journal of Qingdao Agricultural University (Natural Science Edition), vol. 30, Issue 4, pp. 240-246, Dec. 31, 2013.
Kim, S., et al., "Physiological and proteomic analyses of Korean F1 maize (*Zea mays* L.) hybrids under water-deficit stress during flowering", Appl. Biol. Chem. (2019) 62:32.
Halligan, B., et al., "Cloning of the murine cDNA encoding VDJP, a protein homologous to the large subunit of replication factor C and bacterial DNA ligases", Gene (1995) 217-222.
Arend, J., et al., "Hydroquinone: O-glucosytransferase from cultivated Rauvolfia cells: enrichment and partial amino acid sequences", Phytochemistry (2000) 53:187-193.
Enchev, R., et al., "Protein neddylation: beyond cullin-RING ligases", (Nature Reviews: Molecular Cell Biology (2015) 16:30-44.
Bais, H., et al., "The Role of Root Exudates in Rhizophere Interactions with Plants and Other Organisms", Annual Review. Plant Biol. (2006) 57:233-266.
Goepfert, S., et al., "Molecular Identification and Characterization of the *Arabidopsis* D3,5, D2,4-Dienoyl-Coenzyme A Isomerase, a Peroxisomal Enzyme Participating in the b-Oxidation Cycle of Unsaturated Fatty Acids1", Plant Physiology (2005) 138:1947-1956.
Thomas, P., et al: "Endophytic Bacteria Associated with Growing Shoot Tips of Banana (*Musa* sp.) cv. Grand Naine and the Affinity of Endophytes to the Host", Microbial Ecology, Springer-Verlag, NE, vol. 58, No. 4, Jul. 25, 2009 (Jul. 25, 2009), pp. 952-964, XP019757395, ISSN: 1432-184X, DOI: 10.1007 /S00248-009-9559-Z.

(56) References Cited

OTHER PUBLICATIONS

Database Geneseq [Online] Sep. 30, 2010 (Sep. 30, 2010), "Cellulomonas fermentans 16s rRNA gene Seq ID:39.", retrieved from EBI accession No. GSN:AWL84299 Database accession No. AWL84299; & JP 2009 072168 A (Univ of Occupational & Environ) Apr. 9, 2009 (Apr. 9, 2009).
European Patent Office, Partial European Search Report, European Patent Application No. 20171870.7, dated Nov. 20, 2020, 18 Pages.
European Patent Office, European Search Report, European Patent Application No. 20171870.7, dated Mar. 1, 2021, 15 Pages.
Andreolli, M., et al., "Endophytic Burkholderia fungorum DBT1 can improve phytoremediation efficiency of polycyclic aromatic hyrocarbons", Chemosphere, Pergamon Press, Oxford, GB, vol. 92, No. 6, May 21, 2013, pp. 688-694.
Extended European Search Report for EP 20202875.9, 16 pages.
Douglas, G., et al., "PICRUSt2 for prediction of metagenome functions", Nature Biotechnology, vol. 38, No. 6, Jun. 1, 2020, pp. 685-688.
Kemp, N., et al., "Sarocladium zeae is a systemic endophyte of wheat and an effective biocontrol agent against Fusarium head blight", Biological Control, vol. 149, Publication No. 104329, 10 pages (2020).
Wicklow, D., et al., "A protective endophyte of maize: Acremonium zeae antibiotics inhibitory to Aspergillus flavus and Fasanum verticillioides", Mycol. Res. 109 (5):610-618 (May 2005).
Pan, J., et al., "Effects of host plant environment and Ustilago maydis infection on the fungal endophyte community of maize (*Zea mays*)", New Phytologist, vol. 178, pp. 147-156 (2008).
Wicklow, D., et al., "Occurrence of pyrrocidine and dihydroresorcylide production among Acremonium zeae populations from maize grown in different regions", Canadian Journal of Plant Pathology, vol. 30, pp. 425-433 (2008).
European Patent Office, Partial European Search Report, European Patent Application No. 18791606.9, dated Jul. 26, 2021, 16 Pages.
Abaid-Ullah, M., et al., "Plant Growth Promoting Rhizobacteria: An Alternate Way to Improve Yield and Quality of Wheat (*Triticum aestivum*)", International Journal of Agriculture and Biology, vol. 17, No. 1, Jan. 1, 2015, pp. 51-60.
Colla, G., et al., "Coating seeds with endophytic fungi enhances growth, nutrient uptake, yield and grain quality of winter wheat", International Journal of Plant Production, vol. 9, No. 2, Apr. 1, 2015, pp. 171-190.
Larran, S., et al., "Endophytes from wheat as biocontrol agents against tan spot disease", Biological Control, vol. 92, Sep. 11, 2015, pp. 17-23.
European Patent Office, Search Report, European Patent Application No. 17825317.5, dated Oct. 12, 2021, 9 Pages.
Yuan, J., et al., "Roots from distinct plant developmental stages are capable of rapidly selecting their own microbiome without the influence of environmental and soil edaphic factors", Soil Biology and Biochemistry 89 (2015): 206-209.
Frichot, E., et al., "Testing for Associations between loci and environmental gradients using latent factor mixed models", Mol. Biol. Evol. 30:7 1687-1699 (Year: 2013).
Bicego, M., et al., "Investigating Topic Models' Capabilities in Expression Microarray Data Classification", IEEE/transactions on computational biology and bioinformatics, 9:8 1831-1836 (Year: 2012).
Gerber, G., et al., "Inferring Dynamic Signatures of Microbes in Complex Host Ecosystems", PLOS Computational Biology 8:8 e1002624, 14 pages (Year: 2012).
Holmes, I., et al., "Dirichlet Multinomial Mixtures: Generative Models for Microbial Metagenomics", PLoSONE 7:2, e30126, 15 pages (Year: 2012).
Kim, Y., et al., "Deciphering the human microbiome using next-generation sequencing data and bioinformatics approaches", Methods 79-80, p. 52-59 (Year: 2015).
Anesi, A., et al., "Towards a scientific interpretation of the terrior concept: platicisity of the grape berry metabolome", BMP plant biology 15:191, 17 pages (Year: 2015).

Hill, S.T., The pursuit of hoppiness: propelling hop into the genomic era. Thesis, Oregon State University, 80 pages (Year: 2016).
Li, M., et al., "Persistent homology and the branching topologies of plants", American Journal of Botany, 104:3, 349-353 (Year: 2017).
Schuerger, A., "Microbial Ecology of a Crewed Rover Traverse in the Arctic: Low Microbial Dispersal and Implications for Planetary Protection on Human Mars Missions", Astrobiology, vol. 15, No. 6, 2015, pp. 478-491.
Timmusk, S., "Paenibacillus polymyxa antagonizes oomycete plant pathogens Phytophthora palmivora and Pythium aphanidermatum", Journal of Applied Microbiology, GB, vol. 105, No. 5, Jan. 5, 2009, pp. 1473-1481.
Fatima, Z., "Antifungal activity of plant growth-promoting rhizobacteria isolates against Rhizoctonia solani in wheat", African Journal of Biotechnology, vol. 8(2), pp. 219-225, Jan. 19, 2009, pp. 219-225.
Sato, I., et al., "Suppressive Potential of Paenibacillus Strains Isolated from the Tomato Phyllosphere against Fusarium Crown and Root Rot of Tomato", Microbes Environ, vol. 29, No. 2, 168-177, 2014.
Database Genbank [Online] NIH; Jul. 25, 2016 (Jul. 25, 2016), Steyaert J M et al: "Trichoderma hamatum endochitinase (chit42) gene, partial eds", XP055973252, Database accession No. AY258898 abstract.
Database Genbank [Online] NIH; Sep. 25, 1998 (Sep. 25, 1998), Giczey G et al: "endochitinase [Trichoderma hamatum]", XP055973364, Database accession No. AAC60385 abstract.
Database Genbank [Online] NIH; Sep. 25, 1998 (Sep. 25, 1998), Giczey G et al: "Trichoderma hamatum endochitinase gene, complete eds", XP055973251, Database accession No. U88560 abstract.
Liu, H.J., et al., "Bacillus subtilis strain A2-9 16S ribosomal RNA gene, partial sequence", Accession No. JF496331, deposited Aug. 2011.
Li, C., et al., "Bacillus subtilis strain B2-1 16S ribosomal RNA gene, partial sequence", Accession No. JN256114, deposited Sep. 2011.
Jiang, L., "Bacillus subtilis strain jllsy 16S ribosomal RNA gene, partial sequence", Accession No. FJ793201, deposited Apr. 2009.
Choi, N.S., et al., "Bacillus licheniformis strain DJ-2 16S ribosomal RNA gene, partial sequence", Accession No. FJ435676, deposited Jan. 2009.
Peng, S., et al., "Bacillus subtilis strain CCM9 16S ribosomal RNA gene, partial sequence", Accession No. HQ536000, deposited Dec. 2010.
Jee, H., et al., "Bacillus subtilis strain R2-1 16S ribosomal RNA gene, partial sequence", Accession No. EU852929, deposited Jul. 2009.
Zhao, Y., et al., "Bacillus amyloliquefaciens strain BGP14 16S ribosomal RNA gene, partial sequence", Accession No. JQ734536, deposited May 2012.
Allard, G. et al., "SPINGO: a rapid species-classifier for microbial amplicon sequences," BMC Bioinformatics, 2015, vol. 16, No. 324, 8 pages.
Anders, S. et al., "Differential expression analysis for sequence count data," Genome Biology, 2010, vol. 11, No. 11, pp. R106.
Ansari, M.A.; Brownbridge, M.; Shah, F.A.; Butt, T.M. Efficacy of entomopathogenic fungi against soil-dwelling life stages of western flower thrips, Frankliniella occidentals, in plant-growing media. Entomol. Exp. Appl. 2008, 127, 80-87.
Asaff, A.; Cerda-García-Rojas, C.; De la Torre, M. Isolation of dipicolinic acid as an insecticidal toxin from Paecilomyces fumosoroseus. Appl. Microbiol. Biotechnol. 2005, 68, 542-547.
BB-CBI, "*Beauveria bassiana* (white muscardine fungus)," Invasive Species Compendium, 2021, pp. 1-68.
Beris, E.I.; Papachristos, D.P.; Fytrou, A.; Antonatos, S.A.; Kontodimas, D.C. Pathogenicity of three entomopathogenic fungi on pupae and adults of the Mediterranean fruit fly, *Ceratitis capitata* (Diptera: Tephritidae). J. Pest Sci. 2013, 86, 275-284.
Chen, F. et al., "Assessing Performance of Orthology Detection Strategies Applied to Eukaryotic Genomes," PLoS ONE, Apr. 2007, No. 4, pp. e383.
Cole, J.R. et al., "Ribosomal Database Project: data and tools for high throughput rRNA analysis," Nucleic Acids Research, 2014, vol. 42, pp. D633-D642.

(56) References Cited

OTHER PUBLICATIONS

Deshpande, V. et al., "Fungal identification using a Bayesian classifier and the Warcup training set of internal transcribed spacer sequences," Mycologia, 2016, vol. 108, No. 1, pp. 1-5.

Djian, C. et al., Acetic acid: A selective nematicidal metabolite from culture filtrates of Paecilomyces lilacinus (Thom) Samson and Trichoderma longibrachiatum Rifai. Nematologica 1991, 37, 101-112.

Doster, M.A. et al., "Biocontrol of Aflatoxins in Figs," Proceedings of the Third International Symposium on Fig, 798, 2008, pp. 223-226.

Eberhardt, C. et al., "Proteomic Analysis of Kveim Reagent Identifies Targets of Cellular Immunity in Sarcoidosis," PLOS One, Jan. 23, 2017, vol. 12, No. 1, pp. 1-16.

Edgar, R.C., "UNOISE2: Improved Error-Correction For Illumina 16S and ITS Amplicon Sequncing," BioRxiv, 2016, No. 081257, 21 pages.

Ehteshamul-Haque, S. et al., "Biological control of root rot diseases of okra, sunflower, soybean and mungbean," Pakistan Journal of Botany, vol. 22, No. 2, Jun. 1990, pp. 121-124.

Enright, A.J. et al., "An efficient algorithm for large-scale detection of protein families," Nucleic Acids Research, 2002, vol. 30, No. 7, pp. 1575-1584.

Enright, A.J. et al., "Protein families and Tribes in genome sequence space," Nucleic Acids Research, 2003, vol. 31, No. 15, pp. 4632-4638.

Faria, M.; Wraight, S.P. Biological control of Bemisia tabaci with fungi. Crop Prot. 2001, 20, 767-778.

Fiedler, ?.; Sosnowska, D. Nematophagous fungus *Paecilomyces lilacinus* (Thom) Samson is also a biological agent for control of greenhouse insects and mite pests. BioControl 2007, 52, 547-558.

Friedman, J. et al., "Regularization Path for Generalized Linear Models via Coordinate Descent," Journal of Statistical Software, 2010, vol. 33, No. 1, pp. 1-22.

Hoy, M.A.; Singh, R.; Rogers, M.E. Evaluations of a novel isolate of Isaria fumosorosea for control of the Asian citrus psyllid, *Diaphorina citri* (Hemiptera: Psyllidae). Fla. Entomol. 2010, 93, 24-32.

Kepenekci, I. et al., "Pathogenicity of the Entomopathogenic Fungus, *Purpureocillium lilacinum* TR1 Against the Black Cherry Aphid, *Myzus cerasi* Fabricus (Hemiptera: Aphididae)," Mun. Ent. Zool., vol. 10, No. 1, Jan. 2015, pp. 53-60.

Koljalg. U. et al., "Towards a unified paradigm for sequence-based identification of fungi," Molecular Ecology, 2013, vol. 22, pp. 5271-5277.

Kozich, J.J. et al., "Development of a Dual-Index Sequencing Strategy and Curation Pipeline for Analyzing Amplicon Sequence Data on the MiSeq Illumina Sequencing Platform," Applied and Environmental Microbiology, Sep. 2013, vol. 79, No. 17, pp. 5112-5120.

Li, W. et al., "Ultrafast clustering algorithms for metagenomic sequence analysis," Briefings in Bioinformatics, Nov. 1, 2012, vol. 13, No. 6., pp. 656-668.

McMurdie, P.J. et al., "Waste Not, Want Not: Why Rarefying Microbiome Data Is Inadmissible," PLOS Computational Biology, 2014, vol. 10, No. 4, pp. e1003531.

Mezeal, I.A.; Mizil, S.N.; Hussin, M.S. Researching biocontrol of Trichoderma viride, Paecilomyces lilacinus in contradiction of effectiveness of fungi insulated as of selected therapeutic herbals. Plant Arch. 2018, 18, 1631-1637.

NCBI, "Purpureocillium lilacinum," Taxonomy ID: 33203, 2021, three pages, [Online] [Retrieved on Feb. 27, 2021] Retrieved from the Internet <URL: https://www.ncbi.nlm.nih.gov/Taxonomy/Browser/wwwtax.cgi?id=33203>.

Needleman, S.B. et al., "A General Method Applicable to the Search for Similarities in the Amino Acid Sequence of Two Proteins," Journal Of Molecular Biology, 1970, vol. 28, No. 3, pp. 443-453.

O'Callaghan, M., "Microbial inoculation of seed for improved crop performance: issues and opportunities," Applied Microbiology and Biotechnology, vol. 100, May 2016, pp. 5729-5746.

Pandey, R. K. et al., "Effect of different bioformulations of Paecilomyces lilacinus against root-knot nematode (*Meloidogyne incognita*) infecting tomato (*Solanum esculentum*)," Indian Journal of Agricultural Sciences, vol. 81, No. 3, Mar. 2011, pp. 261-267.

Panyasiri, C.; Attathom, T.; Poehling, H.M. Pathogenicity of entomopathogenic fungi-potential candidates to control insect pests on tomato under protected cultivation in Thailand. J. Plant Dis. Prot. 2007, 114, 278-287.

Paul, N.C.; Deng, J.X.; Lee, J.H.; Yu, S.H. New records of endophytic Paecilomyces inflatus and Bionectria ochroleuca from chili pepper plants in Korea. Mycobiology 2013, 41, 18-24.

Perveen, Z.; Shahzad, S.A. Comparative study of the efficacy of *Paecilomyces* species against root-knot nematode *Meloidogyne incognita*. Pak. J. Nematol. 2013, 31, 125-131.

Piatkowski, J.; Krzyzewska, U.; Nawrot, U. Antifungal activity of enthomopathogenic species of the genus *Paecilomyces*. Mikol. Lek. 2003, 10, 93-99 (with abstract).

Quast, C. et al., "The SILVA ribosomal RNA gene database project: improved data processing and web-based tools," Nucleic Acids Research, 2013, vol. 41, pp. D590-D596.

Raafat, I. et al., "Nezara viridula (Hemiptera: Pentatomidae) Cuticle as a Barrier for Beauveria bassiana and *Paecilomyces* sp. Infection," African Entomology, vol. 23, Iss.1, Mar. 2015, pp. 75-87.

Rajinikanth, R. et al., "Management of nematode induced disease complex in seedlings of cauliflower (*Brsassica oleraceae* var. *botrytis*) using bio-pesticides," Pest Management in Horticultural Ecosystems, vol. 19, No. 2, Dec. 2013, pp. 203-210.

Ratnalikar, K.K. et al., "Biological management of root-rot of cotton caused by Rhizoctonia bataticola," Indian Phytopathol. 44-45, Suppl., XV, 1993, pp. 1-2.

Rideout, J.R. et al., "Subsampled open-reference clustering creates consistent, comprehensive OTU definitions and scales to billions of sequences," PeerJ, 2014, 2:e545.

Roth, A.C.J. et al., "Algorithm of OMA for large-scale orthology inference," BMC Bioinformatics, 2008, vol. 9, pp. 518.

Shenoy, B.D. et al., "Impact of DNA sequence-data on the taxonomy of anamorphic fungi," Fungal Diversity, 2007, vol. 26, No. 10, pp. 1-54.

Shibuya, H. et al., "Transformation of Cinchona Alkaloids into 1-N-Oxide Derivatives by *Endophytic xylaria* sp. Isolated from Chinchona pubescens," Chem Pharm Bull, 2003, vol. 41, No. 1, pp. 71-74.

Singh, S. et al., "Bio-control activity of Purpureocillium lilacinum strains in managing root-knot disease of tomato caused by Meloidogyne incognita," Biocontrol Science and Technology, vol. 23, No. 12, Sep. 2013, pp. 1469-1489.

Sivakumar, T.; Eswaran, A.; Balabaskar, P. Bioefficacy of antagonists against for the management of *Fusarium oxysporum* f. sp. *lycopersici* and Meloidogyne incognita disease complex of tomato under field condition. Plant Arch. 2008, 8, 373-377 (with abstract).

Smith, T.F. et al., "Identification of Common Molecular Subsequences," Journal of Molecular Biology, 1981, vol. 147, pp. 195-197.

Spurgeon, D.W., "Efficacy of Beauveria bassiana Against Lygus hesperus (Hemiptera: Miridae) at Low Temperatures," Journal of Entomological Science, vol. 45, Iss. 3, Jul. 2010, pp. 211-219.

Sword, G. A. et al., "Endophytic fungi alter sucking bug responses to cotton reproductive structures," Insect Science, vol. 24, Mar. 22, 2017, pp. 1003-1014.

Yeo, H.; Pell, J.K.; Alderson, P.G.; Clark, S.J.; Pye, B.J. Laboratory evaluation of temperature effects on the germination and growth of entomopathogenic fungi and on their pathogenicity to two aphid species. Pest Manag. Sci. 2003, 59, 156-165.

Zhang, X-Y. et al., "Diversity and Antimicrobial Activity of Culturable Fungi Isolated from Six Species of the South China Sea Gorgonians," Microbial Ecology, vol. 64, Apr. 2012, pp. 617-627.

Zhou, W. et al., "A fungal endophyte defensive symbiosis affects plant-nematode interactions in cotton," Plant Soil, vol. 422, Dec. 21, 2016, pp. 251-266.

Zuccaro, A., et al., "Endophytic Life Strategies Decoded by Genome and Transcriptome Analyses of the Mutualistic Root Symbiont Piriformospora indica," PLOS Pathogens, 2011, vol. 7, No. 10, e1002290.

(56) References Cited

OTHER PUBLICATIONS

Gaussian process model definition from towarddatascience.com downloaded May 15, 2023 (Year: 2023).
Gaussian process model definition from wikipedia.com, downloaded May 15, 2023 (Year: 2023).
Ghahramani, Z. (2013) Bayesian non-parametrics and the probabilistic approach to modeling. Philosophical transactions of the royal society A, vol. 371, 20110553, 20 pages.
Donahue, J. et al. Adversarial feature learning. arXiv: 1605.09782V7, Apr. 3, 2017.
Singh ("Screening and characterization of plant growth promoting rhizobacteria (PGPR): An overview." Bulletin of Environmental and Scientific Research 4.1-2 (2015): 1-2). (Year: 2016).
Hanapi, et al. ("Biofertilizer: Ingredients for Sustainable Agriculture." Biotechnology Development in Agriculture, Industry and Health: Current Industrial Application and Future Trends 1 (2012): 359-385). (Year: 2012).
Buee, et al. ("The rhizosphere zoo: an overview of plant-associated communities of microorganisms, including phages, bacteria, archaea, and fungi, and of some of their structuring factors." (2009): 189-212). (Year: 2009).
Combined printouts of term definitions from world wide web, performed by mkz Oct. 19, 2022 (Year: 2022).
Sarangi, S., et al., "Agricultural Activity Recognition with Smartshirt and Crop Protocol", IEEE global humanitarian technology conference, p. 298-305 (Year: 2015).
Gibbs, A., et al., "Chemical Diversity: Definition and Quantification", IN Exploiting chemical diversity for drug discovery, Bartlett et al EDS. eIBSN 978-1-84755-255-6 p. 137-160.
Peiffer, J., et al., "The Genetic Architecture of Maize Height", Genetics, vol. 196, p. 1337-1356 (Year: 2015).
Kazemian, M., et al., "Improved accuracy of supervised CRM discovery with interpolated Markov models and cross-specieis comparison", Nucleic Acids Research, 2011, vol. 39, No. 22, 9463-9472.
Yeh, J.H., "Protein Remote Homology Detection Based on Latent Topic Vector Model", International conference on Networking and information technology, p. 456-460, (Year: 2010).
Heydari, A., "A Review on Biological Control of Fungal Plant Pathogens Using Microbial Antagonists", Journal of Biological Sciences, vol. 10 (4) 273-290 (Year: 2010).
Sessitsch, A., et al., "Functional Characteristics of an Endophyte Community Colonizing Rice Roots as Revealed by Metagenomic Analysis", MPMP vol. 25, No. 1, 2012, pp. 28-36.
Muhammad, N., et al., "Endophytes in biotechnology and agriculture", E-COST FA1103 Working Group Meeting in Trento/S. Michele, Italy Nov. 2012. (poster).
Hurek, T., et al., "*Azoarcus* sp. strain BH72 as a model for nitrogen-fixing grass endophytes", Journal of Biotechnology 106 (2003) 169-178.
Engelhard, M., et al., "Preferential occurrence of diazotrophic endophytes, *Azoarcus* spp., in wild rice species and and races of Oryza sativa in comparison with moder races". Environmental Microbiology (2000) 2(2), 131-141.
Sessitsch, A., et al., "Endophytic bacterial communities of field-grown potato plants and their plant-growth-promoting and antagonistic abilities", Can. J. Microbiol. 50: 239-249 (2004).
Sessitsch, A., et al., "Cultivation-independent population analysis of bacterial endophytes in three potato varieties based on eubacterial and Actinomycetes-specific PCR of 16S rRNA genes", FEMS Microbiology Ecology 39 (2002) 23-32.
Minamisawa K., et al., "Anaerobic Nitrogen-Fixing Consortia Consisting of Clostridia Isolated from Gramineous Plants", Applied and Environmental Microbiology, May 2004, p. 3096-3102, vol. 70, No. 5.
Seghers, D., et al., "Impact of Agricultural Practices on the *Zea mays* L. Endophytic Community", Applied and Environmental Microbiology, Mar. 2004, p. 1475-1482, vol. 70, No. 3.
Bulgari, D., et al., "Endophytic Bacterial Diversity in Grapevine (*Vitis vinifera* L.) Leaves Described by 16S rRNA Gene Sequence Analysis and Length Beterogeneity-PCR", The Journal of Microbiology, Aug. 2009, p. 393-401, vol. 47, No. 4.
Amann, R., et al., "Single-cell identification in microbial communities by improved fluorescence in situ hybridization techniques", Nature Reviews Microbiology, 6: 339-348 (2008).
Chelius, M.K., et al., "The Diversity of Archaea and Bacteria in Association with the Roots of *Zea mays* L.", Microb Ecol (2001) 41:252-263.
Edwards, U., et al., "Isolation and direct complete nucleotide determination of entire genes. Characterization of a gene coding for 16S ribosomal RNA", Nucleic Acids Research 17: 7843-7853 (1989).
Prischl, M., et al., "Genetically modified Bt maize lines containing cry3Bb1, cry1A105 or cry1Ab2 do not affect the structure and functioning of root-associated endophyte communities", Applied Soil Ecology 54 (2012) 39-48.
Naveed, M., et al., "The endophyte *Enterobacter* sp. FD17: a maize growth enhancer selected based on rigorous testing of plant beneficial traits and colonization characteristics", Biol Fertil Soils (2014) 50:249-262.
Rashid, M., et al., "Inorganic polyphosphate is needed for swimming, swarming, and twitching motilities of Pseudomonas aeruginosa", PNAS vol. 97, No. 9, Apr. 25, 2000, pp. 4885-4890.
Mehta, S., et al., "An Efficient Method for Qualitative Screening of Phosphate-Solubilizing Bacteria", Current Microbiology vol. 43 (2001), pp. 51-56.
Dunn,R., et al., "Home Life: Factors Structuring the Bacterial Diversity Found within and between Homes", PLoS One, vol. 8, Issue 5, May 2013.
Massol-Deya, A., et al., "Bacterial community fingerprinting of amplified 16S and 16-23S ribosomal DNA gene sequences and restriction endonuclease analysis (ARDRA)", Molecular Microbial Ecology Manual 3.3.2: 1-8, 1995.
Extended European Search Report for Application No. 22190659,7, dated Feb. 10, 2023, 8 pages.
GenBank Accession No. AY148074 published Nov. 30, 2002.
GenBank Accession No. FM998026 published Feb. 10, 2011.
GenBank Accession No. KJ494315 published May 3, 2014.
International Search Report and Written Opinion for PCT/US2022/026051, 38 pages.
Langner Dos Santos Miriam et al: "Benefits Associated with the Interaction of Endophytic Bacteria and Plants", Brazilian Archives of Biology and Technology, vol. 61, No. 0, Jan. 1, 2018 (Jan. 1, 2018), pp. 18160431-2018.
Database GenBank [Online] NIH; Jan. 29, 2016 (Jan. 29, 2016), Wu JR: "Chitinophaga pinensis strain CSB3-50 16S ribosomal RNA gene", XP055948434,accession No. KU305719 Database accession No. KU305719.1 abstract.
Database GenBank [Online] NIH; Mar. 10, 2017 (Mar. 10, 2017), Shaffer JP et al: "Uncultured bacterium clone EHB-PS0362 16S ribosomal RNA gene", XP055948435,accession No. KU978322 Database accession No. KU978322.1 abstract.
Database GenBank [Online] NIH; Jan. 15, 2019 (Jan. 15, 2019), Hu C. J. et al: "*Chitinophaga* sp. strain N15203 16S ribosomal RNA gene", XP055948438,accession No. MK389338 Database accession No. MK389338.1 abstract.
Database GenBank [Online] NIH; Nov. 26, 2014 (Nov. 26, 2014), Han J. H. et al: "*Chitinophaga* sp. NR 1-07 16S ribosomal RNA gene", XP055948440,accession No. KM253104 Database accession No. KM253104.1 abstract.
Database GenBank [Online] NIH; Sep. 2, 2017 (Sep. 2, 2017), Jiayu T. J.: "*Chitinophaga* sp. strain PRd7 16S ribosomal RNA gene", XP055948441,accession No. KY203972 Database accession No. KY203972.1 abstract.
Database GenBank [Online] NIH; Oct. 1, 2010 (Oct. 1, 2010), Aslam Z. et al: "*Chitinophaga* sp. Z2-YC6856 16S ribosomal RNA gene", XP055948442,accession No. GQ369124 Database accession No. GQ369124.1 abstract.
Database GenBank [Online] NIH; Jun. 10, 2014 (Jun. 10, 2014), Zhang B. G.: "*Chitinophaga oryziterrae* strain ZBGKL4 16S ribosomal RNA gene", XP055948443,accession No. KJ734873 Database accession No. KJ734873.1 abstract.

(56) References Cited

OTHER PUBLICATIONS

Chung, E., et al: *Chitinophaga oryziterrae* sp. nov., isolated from the rhizosphere soil of rice (*Oryza sativa* L.) II, International Journal of Systematic and Evolutionary Microbiology, vol. 62, No. Pt_12, Dec. 1, 2012 (Dec. 1, 2012), pp. 3030-3035.

Proença Diogo Neves et al: "*Chitinophaga costaii* sp. nov., an endophyte of Pinus pinaster, and emended description of Chitinophaga niabensis", International Journal of Systematic and Evolutionary Microbiology, vol. 64, No. Pt_4, Apr. 1, 2014 (Apr. 1, 2014), pp. 1237-1243.

Elad, Y., et al: "Control of Rhizoctonia solani in cotton by seed-coating with *Trichoderma* spp. spores", Plant and Soil, vol. 66, No. 2, Jun. 1, 1982 (Jun. 1, 1982), pp. 279-281.

Harman, G.E., et al: "Trichoderma hamatum effects on seed and seedling disease induced in radish and pea by *Pythium* spp. or Rhizoctonia solani", Phytopathology, Dec. 1, 1980 (Dec. 1, 1980), pp. 1167-1172.

Harman, G.E., et al: "Factors affecting Trichoderma hamatum applied to seeds as a biocontrol agent", Phytopathology, Jun. 1, 1981 (Jun. 1, 1981), pp. 569-572.

Giczey, G., et al: "Homologous transformation of Trichoderma hamatum with an endochitinase encoding gene, resulting in increased levels of chitinase activity", FEMS Microbiology Letters, Jan. 1, 1998 (Jan. 1, 1998), pp. 247-252.

Freitas, R., et al: "Cloning and characterization of a protein elicitor Sml gene from Trichoderma harzianum", Biotechnology Letters, vol. 36, No. 4, Dec. 10, 2013 (Dec. 10, 2013), pp. 783-788.

Database Genbank [Online] NIH; Jan. 1, 2008 (Jan. 1, 2008), Hanada RE et al: "Trichoderma hamatum strain DIS 65G 18S ribosomal RNA gene, partial sequence; internal transcribed spacer 1", XP055973221, Database accession No. EU264000 abstract.

Database Genbank [Online] NIH; Sep. 6, 2013 (Sep. 6, 2013), Samuels G J et al: "Trichoderma hamatum strain Dis 240j actin (act) gene, partial cds", XP055973271, Database accession No. EU856256 abstract.

Database Genbank [Online] NIH; May 23, 2005 (May 23, 2005), Steyaert J M et al: "Trichoderma hamatum alkaline proteinase (prb1) gene, complete cds", XP055973243, Database accession No. AY258899 abstract.

Database Genbank [Online] NIH; Apr. 11, 2019 (Apr. 11, 2019), Chaverri P et al: "Trichoderma hamatum strain GJS 04-207 calmodulin (CAL) gene, partial cds", XP055973272, Database accession No. FJ442285 abstract.

Aerts A et al: "NCBI Reference Sequence: XP_024757499.1: glycoside hydrolase family 18 protein [Trichoderma asperellum CBS 433.97]", Apr. 26, 2018 (Apr. 26, 2018), pp. 1-2, XP055973177.

Database accession No. JQ759107, European Nucleotide Archive [Online] EMBL's European Bioinformatics Institute; Mar. 7, 2012, U'ren J M et al.: "Sordariomycetes sp.genotype 60 isolate AK0688 internal transcribed spacer."

Database accession No. MG917011, European Nucleotide Archive [Online] EMBL's European Bioinformatics Institute; Feb. 21, 2019, Lagarde A. et al.: "*Coniochaeta* sp.isolate Gir_07 internal transcribed spacer 1, partial sequence."

Database accession Nos. MZ267873, MZ267979, MZ267926, MZ267820; European Nucleotide Archive [Online] EMBL's European Bioinformatics Institute; Sep. 11, 2021, Arnold A E: "Coniochaeta nivea isolate LG0013 various submissions."

Database accession Nos. MZ267874, MZ267980, MZ267927, MZ267821; European Nucleotide Archive [Online] EMBL's European Bioinformatics Institute; Sep. 11, 2021, Arnold A E: "Coniochaeta nivea isolate LG0023."

Arnold, A. Elizabeth et al; "*Coniochaeta elegans* sp. nov., *Coniochaeta montana* sp. nov. and *Coniochaeta nivea* sp. hov., three new species of endophytes with distinctive morphology and functional traits", Int J Syst Evolu Microb vol. 71 No. 11, p. 5003.

Kokaew, J. et al; "Coniochaeta ligniaria an endophytic fungus from Baeckea frutescens and its antagonistic effects against plant pathogenic fungi", Thai Journal of Agricultural Science, vol. 44, Jun. 1, 2011, pp. 123-131.

Lagarde A. et al: "Antiproliferative and antibiofilm potentials of endolichenic fungi associated with the lichen Nephroma laevigatum", Journal of Applied Microbiology, vol. 126, No. 4, Jan. 30, 2019, pp. 1044-1058.

Nilsson et al; "Correspondence: Intraspecific ITS Variability in the Kingdom Fungi as Expressed in the International Sequence Databases and Its Implications for Molecular Species Identification", Evolutionary Bioinformatics, Jan. 1, 2008, pp. 193-201.

Trifonova, R. et al; "Interactions of plant-beneficial bacteria with the ascomycete Coniochaeta ligniaria", Journal of Applied Microbiology, vol. 106, No. 6, Jun. 1, 2009, pp. 1859-1866.

U'ren, Jana M., et al.; "Community Analysis Reveals Close Affinities Between Endophytic and Endolichenic Fungi in Mosses and Lichens", Microbial Ecology, vol. 60, No. 2, Jul. 13, 2010, pp. 340-353.

Shah, S., et al: "Colonization with non-mycorrhizal culturable endophytic fungi enhances orchid growth and indole acetic acid production", BMC Microbiology, vol. 22, No. 1, Jan. 1, 2022, pp. 1-13.

\* cited by examiner

ENDOPHYTE COMPOSITIONS AND METHODS FOR IMPROVEMENT OF PLANT TRAITS IN PLANTS OF AGRONOMIC IMPORTANCE

CROSS REFERENCE TO RELATED APPLICATIONS

This application is the National Stage of International Application No. PCT/US2016/068144, filed Dec. 21, 2016, which claims the benefit of and priority to U.S. Provisional Application No. 62/270,539, filed Dec. 21, 2015, which is hereby incorporated in its entirety by reference.

SEQUENCE LISTING

The instant application contains a Sequence Listing with 1711 sequences which has been submitted via EFS-Web and is hereby incorporated by reference in its entirety. Said ASCII copy, created on Dec. 21, 2016 is named 35282PCT_CRF_sequencelisting.txt and is 1,027,237 bytes in size.

FIELD OF THE INVENTION

This invention relates to compositions and methods for improving the traits of plants, particularly agricultural plants. For example, this invention describes combinations of beneficial bacteria and fungi that are capable of living in a plant, which may be used to impart improved agronomic traits to plants. The disclosed invention also describes methods of improving plant characteristics by introducing such beneficial combinations of bacteria and/or fungi to those plants. Further, this invention also provides methods of treating seeds and other plant elements with combinations of beneficial bacteria and/or fungi that are capable of living within a plant, to impart improved yield, stress resistance, disease resistance, and other agronomic characteristics to plants.

BACKGROUND

According the United Nations Food and Agricultural Organization (UN FAO), the world's population will exceed 9.6 billion people by the year 2050, which will require significant improvements in agricultural to meet growing food demands. There is a need for improved agricultural plants that will enable the nearly doubled food production demands with fewer resources and more environmentally sustainable inputs, for plants with improved responses to various biotic and abiotic stresses.

Today, crop performance is optimized via of technologies directed towards the interplay between crop genotype (e.g., plant breeding, genetically-modified (GM) crops) and its surrounding environment (e.g., fertilizer, synthetic herbicides, pesticides). While these paradigms have assisted in doubling global food production in the past fifty years, yield growth rates have stalled in many major crops and shifts in the climate have been linked to production declines in important crops such as wheat. In addition to their long development and regulatory timelines, public fears of GM-crops and synthetic chemicals has challenged their use in many key crops and countries, resulting in a complete lack of acceptance for GM traits in wheat and the exclusion of GM crops and many synthetic chemistries from European markets. Thus, there is a significant need for innovative, effective, and publically-acceptable approaches to improving the intrinsic yield and resilience of crops to severe stresses.

Provided herein are synthetic combinations, and methods of use thereof, comprising a plant element and a plurality of heterologously disposed endophytes in an effective amount to confer an improved trait of agronomic importance to a host plant.

SUMMARY OF THE INVENTION

In some embodiments, disclosed herein are methods of preparing a synthetic combination, comprising inoculating a plurality of plant elements with a formulation comprising at least a first and a second endophyte population heterologously disposed to the plant elements, wherein the first endophyte comprises a nucleic acid sequence having at least 97% identity to a nucleic acid sequence selected from column A of a pair of endophytes listed in any of Tables 10-16 and the second endophyte comprises a nucleic acid sequence having at least 97% identity to the nucleic acid sequence selected from column B of the pair, wherein the endophyte populations are present in the formulation in an amount capable of modulating a trait of agronomic importance in plants comprising or derived from said plant elements, as compared to reference isoline plants not comprising or not derived from plant elements inoculated with said formulation.

In other embodiments, disclosed herein are methods of preparing a synthetic combination, comprising inoculating a plurality of seeds with a formulation comprising at least a first and a second endophyte population heterologously disposed to the seeds, wherein the first endophyte comprises a nucleic acid sequence having at least 97% identity to a nucleic acid sequence selected from column A of a pair of endophytes listed in any of Tables 10-16 and the second endophyte comprises a nucleic acid sequence having at least 97% identity to the nucleic acid sequence selected from column B of the pair, wherein the endophytes are present in the formulation in an amount capable of modulating a trait of agronomic importance, as compared to reference isoline seeds sowed under the same conditions.

In still other embodiments, disclosed herein are methods of improving a plant phenotype under stress conditions, comprising inoculating a plurality of plant elements with a formulation comprising at least a first and a second endophyte population heterologously disposed to the plant elements, wherein the first endophyte comprises a nucleic acid sequence having at least 97% identity to a nucleic acid sequence selected from column A of a pair of endophytes listed in any of Tables 10-16 and the second endophyte comprises a nucleic acid sequence having at least 97% identity to the nucleic acid sequence selected from column B of the pair, wherein said phenotype is improved as compared to plant elements of reference isoline plants not inoculated with said formulation.

In some embodiments of any of the methods described herein, the stress condition is a biotic or abiotic stress, or a combination of one or more biotic or abiotic stresses. In some embodiments of any of the methods described herein, the stress condition is an abiotic stress selected from the group consisting of: drought stress, salt stress, metal stress, heat stress, cold stress, low nutrient stress, and excess water stress, and combinations thereof. In some embodiments of any of the methods described herein, the stress condition is drought stress. In some embodiments of any of the methods described herein, the stress condition is a biotic stress selected from the group consisting of: insect infestation, nematode infestation, complex infection, fungal infection, bacterial infection, oomycete infection, protozoal infection, viral infection, herbivore grazing, and combinations thereof.

In some embodiments of any of the methods described herein, the plant phenotype is selected from the group consisting of: increased germination rate, increased disease resistance, increased heat tolerance, increased drought tolerance, increased water use efficiency, increased cold tolerance, increased salinity tolerance, increased metal tolerance, increased herbicide tolerance, increased chemical tolerance, increased nitrogen utilization, increased nitrogen use efficiency, resistance to nitrogen stress, increased tolerance to low nitrogen stress, improved nitrogen fixation, increased pest resistance, increased herbivore resistance, increased pathogen resistance, increased insect resistance, increased yield, increased yield under water-limited conditions, increased grain or fruit mass, kernel moisture content, increased number of ears, increased number of kernels per ear, health enhancement, increased vigor improvement, growth improvement, photosynthetic capability improvement, nutrition enhancement, altered protein content, altered oil content, increased biomass, increased root biomass, increased root length, increased root surface area, improved root architecture, increased shoot length, increased shoot height, increased shoot biomass, increased seed weight, altered seed carbohydrate composition, altered seed oil composition, increased number of pods, delayed senescence, stay-green, altered seed protein composition, increased dry weight of mature seeds, increased fresh weight of mature seeds, increased number of mature seeds per plant, increased number of flowers per plant, increased chlorophyll content, increased photosynthesis rate, increased number of leaves, increased number of pods per plant, increased length of pods per plant, reduced number of wilted leaves per plant, reduced number of severely wilted leaves per plant, increased number of non-wilted leaves per plant, increased resistance to a fungal pathogen, increased resistance to a bacterial pathogen, increased resistance to a viral pathogen, increased resistance to a nematode, a detectable modulation in the level of a metabolite, a detectable modulation in gene expression, a detectable modulation in the proteome, and combinations thereof. In some embodiments of any of the methods described herein, the plant phenotype is increased drought tolerance. In some embodiments of any of the methods described herein, the plant phenotype is increased water use efficiency. In some embodiments of any of the methods described herein, the plant phenotype is increased root length. In some embodiments of any of the methods described herein, the plant phenotype is increased root surface area.

In some embodiments of any of the methods described herein, at least one of the first endophyte and the second endophyte is a bacteria of a family selected from the group consisting of: Acetobacteraceae, Acidobacteriaceae, Acidothermaceae, Aerococcaceae, Alcaligenaceae, Alicyclobacillaceae, Alteromonadaceae, Anaerolineaceae, Aurantimonadaceae, Bacillaceae, Bacteriovoracaceae, Bdellovibrionaceae, Bradyrhizobiaceae, Brevibacteriaceae, Brucellaceae, Burkholderiaceae, Carboxydocellaceae, Caulobacteraceae, Cellulomonadaceae, Chitinophagaceae, Chromatiaceae, Chthoniobacteraceae, Chthonomonadaceae, Clostridiaceae, Comamonadaceae, Corynebacteriaceae, Coxiellaceae, Cryomorphaceae, Cyclobacteriaceae, Cytophagaceae, Deinococcaceae, Dermabacteraceae, Dermacoccaceae, Enterobacteriaceae, Enterococcaceae, Erythrobacteraceae, Fibrobacteraceae, Flammeovirgaceae, Flavobacteriaceae, Frankiaceae, Fusobacteriaceae, Gaiellaceae, Gemmatimonadaceae, Geodermatophilaceae, Glycomycetaceae, Haliangiaceae, Halomonadaceae, Holosporaceae, Hyphomicrobiaceae, Iamiaceae, Intrasporangiaceae, Kineosporiaceae, Koribacteraceae, Lachnospiraceae, Lactobacillaceae, Legionellaceae, Leptospiraceae, Leuconostocaceae, Methylobacteriaceae, Methylocystaceae, Methylophilaceae, Microbacteriaceae, Micrococcaceae, Micromonosporaceae, Moraxellaceae, Mycobacteriaceae, Mycoplasmataceae, Myxococcaceae, Nakamurellaceae, Neisseriaceae, Nitrosomonadaceae, Nocardiaceae, Nocardioidaceae, Oceanospirillaceae, Opituaceae, Oxalobacteraceae, Paenibacillaceae, Parachlamydiaceae, Pasteurellaceae, Patulibacteraceae, Peptostreptococcaceae, Phyllobacteriaceae, Piscirickettsiaceae, Planctomycetaceae, Planococcaceae, Polyangiaceae, Porphyromonadaceae, Prevotellaceae, Promicromonosporaceae, Pseudomonadaceae, Pseudonocardiaceae, Rhizobiaceae, Rhodobacteraceae, Rhodospirillaceae, Roseiflexaceae, Rubrobacteriaceae, Sandaracinaceae, Sanguibacteraceae, Saprospiraceae, Segniliparaceae, Shewanellaceae, Sinobacteraceae, Solibacteraceae, Solimonadaceae, Solirubrobacteraceae, Sphingobacteriaceae, Sphingomonadaceae, Spiroplasmataceae, Sporichthyaceae, Sporolactobacillaceae, Staphylococcaceae, Streptococcaceae, Streptomycetaceae, Syntrophobacteraceae, Veillonellaceae, Verrucomicrobiaceae, Weeksellaceae, Xanthobacteraceae, and Xanthomonadaceae.

In some embodiments of any of the methods described herein, at least one of the first endophyte and the second endophyte is a fungus of a family selected from the group consisting of: Aspergillaceae, Ceratobasidiaceae, Coniochaetaceae, Cordycipitaceae, Corticiaceae, Cystofilobasidiaceae, Davidiellaceae, Debaryomycetaceae, Dothioraceae, Erysiphaceae, Filobasidiaceae, Glomerellaceae, Hydnaceae, Hypocreaceae, Leptosphaeriaceae, Montagnulaceae, Mortierellaceae, Mycosphaerellaceae, Nectriaceae, Orbiliaceae, Phaeosphaeriaceae, Pleosporaceae, Pseudeurotiaceae, Rhizopodaceae, Sclerotiniaceae, Stereaceae, and Trichocomaceae.

In some embodiments of any of the methods described herein, the first endophyte is capable of metabolizing as a sole carbon source at least one of a-D-Glucose, Arbutin, b-Methyl-D-Galactoside, b-Methyl-D-Glucoside, D-Arabitol, D-Cellobiose, Dextrin, D-Fructose, D-Galactose, D-Gluconic acid, D-Glucosamine, Dihydroxyacetone, DL-Malic acid, D-Mannitol, D-Mannose, D-Melezitose, D-Melibiose, D-Raffinose, D-Ribose, D-Trehalose, D-Xylose, g-Amino-N-Butyric acid, g-Cyclodextrin, Gelatin, Gentiobiose, Glycogen, i-Erythritol, L-Alanine, L-Arabinose, L-Galactonic acid-g-Lactone, L-Histidine, L-Proline, L-Rhamnose, Maltitol, Maltose, Maltotriose, N-Acetyl-D-Glucosamine, Palatinose, Pectin, Salicin, Stachyose, Sucrose, and Turanose.

In some embodiments of any of the methods described herein, the second endophyte is capable of metabolizing as a sole carbon source at least one of a-D-Glucose, Arbutin, b-Methyl-D-Galactoside, b-Methyl-D-Glucoside, D-Arabitol, D-Cellobiose, Dextrin, D-Fructose, D-Galactose, D-Gluconic acid, D-Glucosamine, Dihydroxyacetone, DL-Malic acid, D-Mannitol, D-Mannose, D-Melezitose, D-Melibiose, D-Raffinose, D-Ribose, D-Trehalose, D-Xylose, g-Amino-N-Butyric acid, g-Cyclodextrin, Gelatin, Gentiobiose, Glycogen, i-Erythritol, L-Alanine, L-Arabinose, L-Galactonic acid-g-Lactone, L-Histidine, L-Proline, L-Rhamnose, Maltitol, Maltose, Maltotriose, N-Acetyl-D-Glucosamine, Palatinose, Pectin, Salicin, Stachyose, Sucrose, and Turanose.

In some embodiments of any of the methods described herein, the formulation comprises the purified microbial population at a concentration of at least about 10^2 CFU/ml or spores/ml in a liquid formulation or about 10^2 CFU/gm or spores/ml in a non-liquid formulation.

In some embodiments of any of the methods described herein, the trait of agronomic importance is selected from the group consisting of: disease resistance, heat tolerance, drought tolerance, water use efficiency, cold tolerance, salinity tolerance, metal tolerance, herbicide tolerance, chemical tolerance, nitrogen utilization, nutrient utilization, resistance to nitrogen stress, nitrogen fixation, pathogen resistance, insect resistance, yield, yield under water-limited conditions, grain weight, fruit weight, kernel moisture content, number of ears, number of kernels per ear, health enhancement, vigor, growth, photosynthetic capability, nutrition enhancement, altered protein content, altered oil content, biomass, root biomass, root length, root surface area, root architecture, shoot length, shoot height, shoot biomass, seed weight, seed carbohydrate composition, seed oil composition, number of pods, delayed senescence, stay-green, seed protein composition, dry weight of mature seeds, fresh weight of mature seeds, number of mature seeds per plant, number of flowers per plant, chlorophyll content, rate of photosynthesis, number of leaves, number of pods per plant, length of pods per plant, number of wilted leaves per plant, number of severely wilted leaves per plant, number of non-wilted leaves per plant, resistance to a fungal pathogen, resistance to a bacterial pathogen, resistance to a viral pathogen, resistance to a nematode, a detectable modulation in the level of a metabolite, a detectable modulation in gene expression, a detectable modulation in the proteome, and combinations thereof.

In some embodiments of any of the methods described herein, a plurality of plant elements are selected from the group consisting of: whole plants, seedlings, meristematic tissues, ground tissues, vascular tissues, dermal tissues, seeds, leaves, roots, shoots, stems, flowers, fruits, stolons, bulbs, tubers, corms, keikis, buds, and combinations thereof. In some embodiments of any of the methods described herein, a plurality of plant elements are seeds.

In some embodiments of any of the methods described herein, at least one of endophytes is capable of localizing in a plant element of a plant grown from innoculated seeds, the plant element selected from the group consisting of: whole plant, seedling, meristematic tissue, ground tissue, vascular tissue, dermal tissue, seed, leaf, root, shoot, stem, flower, fruit, stolon, bulb, tuber, corm, keiki, bud, and combinations thereof.

In some embodiments of any of the methods described herein, a plurality of seeds are placed into a substrate that promotes plant growth. In some embodiments of any of the methods described herein, a substrate that promotes plant growth is soil. In some embodiments of any of the methods described herein, seeds are placed in the soil in rows, with substantially equal spacing between each seed within each row.

In some embodiments of any of the methods described herein, the formulation further comprises one or more of the following: a stabilizer, or a preservative, or a carrier, or a surfactant, or an anticomplex agent, or any combination thereof. In some embodiments of any of the methods described herein, the formulation further comprises one or more of the following: a fungicide, a nematicide, a bactericide, a insecticide, a herbicide, or any combination thereof.

In some embodiments of any of the methods described herein, the plurality of seeds are modified seeds.

In some embodiments a plant derived from the synthetic combinations prepared by any of the methods described herein, comprises at least one of the first and second endophytes in at least one of its plant elements.

In some embodiments the progeny of a plant derived from the synthetic combinations prepared by any of the methods described herein, comprises at least one of the first and second endophytes in at least one of its plant elements.

In some embodiments seed compositions prepared by any of the methods described herein, comprise inoculated seeds confined within an object selected from the group consisting of: bottle, jar, ampule, package, vessel, bag, box, bin, envelope, carton, container, silo, shipping container, truck bed, and case.

In some embodiments, disclosed herein are methods of treating seedlings, comprising inoculating foliage or rhizosphere of a plurality of agricultural plant seedlings with a formulation comprising at least a first and a second endophyte population heterologously disposed to the foliage or rhizosphere, wherein the first endophyte comprises a nucleic acid sequence having at least 97% identity to a nucleic acid sequence selected from column A of a pair of endophytes listed in any of Tables 10-16 and the second endophyte comprises a nucleic acid sequence having at least 97% identity to the nucleic acid sequence selected from column B of the pair, and growing the inoculated seedlings.

In some embodiments, disclosed herein are methods for modulating a plant trait comprising inoculating a plurality of agricultural plant seedlings with a formulation comprising at least a first and a second endophyte population heterologously disposed to the seedlings, wherein the first endophyte comprises a nucleic acid sequence having at least 97% identity to a nucleic acid sequence selected from column A of a pair of endophytes listed in any of Tables 10-16 and the second endophyte comprises a nucleic acid sequence having at least 97% identity to the nucleic acid sequence selected from column B of the pair, wherein the formulation is capable of providing a benefit to the vegetation, or to a crop produced from the vegetation.

In some embodiments, disclosed herein are methods for modulating a plant trait comprising inoculating vegetation, or an area adjacent the vegetation, with a formulation comprising at least a first and a second endophyte population heterologously disposed to the vegetation, wherein the first endophyte comprises a nucleic acid sequence having at least 97% identity to a nucleic acid sequence selected from column A of a pair of endophytes listed in any of Tables 10-16 and the second endophyte comprises a nucleic acid sequence having at least 97% identity to the nucleic acid sequence selected from column B of the pair, wherein the formulation is capable of providing a benefit to the vegetation, or to a crop produced from the vegetation.

In some embodiments, disclosed herein are methods for modulating a plant trait comprising inoculating soil with a formulation, the formulation comprising at least a first and a second endophyte population heterologously disposed to the soil, wherein the first endophyte comprises a nucleic acid sequence having at least 97% identity to a nucleic acid sequence selected from column A of a pair of endophytes listed in any of Tables 10-16 and the second endophyte comprises a nucleic acid sequence having at least 97% identity to the nucleic acid sequence selected from column B of the pair, wherein the formulation is capable of providing a benefit to seeds planted within the soil, or to a crop produced from plants grown in the soil.

In some embodiments of any of the methods described herein, at least one of the first or second endophytes is capable of exhibiting production of an auxin, nitrogen fixation, production of an antimicrobial, production of a siderophore, mineral phosphate solubilization, production of a cellulase, production of a chitinase, production of a xylanase, or production of acetoin. In some embodiments of any of the methods described herein, at least one of the first or second endophytes is capable of exhibiting at least two of: production of an auxin, nitrogen fixation, production of an antimicrobial, production of a siderophore, mineral phosphate solubilization, production of a cellulase, production of a chitinase, production of a xylanase, and production of acetoin.

In some embodiments of any of the methods described herein, at least one of the first or second endophytes is capable of metabolizing at least one of a-D-Glucose, Arbutin, b-Methyl-D-Galactoside, b-Methyl-D-Glucoside, D-Arabitol, D-Cellobiose, Dextrin, D-Fructose, D-Galactose, D-Gluconic acid, D-Glucosamine, Dihydroxyacetone, DL-Malic acid, D-Mannitol, D-Mannose, D-Melezitose, D-Melibiose, D-Raffinose, D-Ribose, D-Trehalose, D-Xylose, g-Amino-N-Butyric acid, g-Cyclodextrin, Gelatin, Gentiobiose, Glycogen, i-Erythritol, L-Alanine, L-Arabinose, L-Galactonic acid-g-Lactone, L-Histidine, L-Proline, L-Rhamnose, Maltitol, Maltose, Maltotriose, N-Acetyl-D-Glucosamine, Palatinose, Pectin, Salicin, Stachyose, Sucrose, and Turanose. In some embodiments of any of the methods described herein, at least one of the first or second endophytes is capable of metabolizing at least two of a-D-Glucose, Arbutin, b-Methyl-D-Galactoside, b-Methyl-D-Glucoside, D-Arabitol, D-Cellobiose, Dextrin, D-Fructose, D-Galactose, D-Gluconic acid, D-Glucosamine, Dihydroxyacetone, DL-Malic acid, D-Mannitol, D-Mannose, D-Melezitose, D-Melibiose, D-Raffinose, D-Ribose, D-Trehalose, D-Xylose, g-Amino-N-Butyric acid, g-Cyclodextrin, Gelatin, Gentiobiose, Glycogen, i-Erythritol, L-Alanine, L-Arabinose, L-Galactonic acid-g-Lactone, L-Histidine, L-Proline, L-Rhamnose, Maltitol, Maltose, Maltotriose, N-Acetyl-D-Glucosamine, Palatinose, Pectin, Salicin, Stachyose, Sucrose, and Turanose.

In some embodiments of any of the methods described herein, each of the first and second endophyte is present at a concentration of at least $10^2$ CFU or spores/ml in the formulation.

In some embodiments of any of the methods described herein, inoculating comprises spraying, immersing, coating, encapsulating, or dusting the seeds or seedlings with the formulation.

In some embodiments of any of the methods described herein, a benefit or plant trait is selected from the group consisting of: increased root biomass, increased root length, increased height, increased shoot length, increased leaf number, increased water use efficiency, increased tolerance to low nitrogen stress, increased nitrogen use efficiency, increased overall biomass, increase grain yield, increased photosynthesis rate, increased tolerance to drought, increased heat tolerance, increased salt tolerance, increased resistance to nematode stress, increased resistance to a fungal pathogen, increased resistance to a bacterial pathogen, increased resistance to a viral pathogen, a detectable modulation in the level of a metabolite, a detectable modulation in gene expression, a detectable modulation in the proteome, and combinations thereof.

In some embodiments of any of the methods described herein, a benefit or plant trait comprises at least two benefits or agricultural traits selected from the group consisting of: increased root biomass, increased root length, increased height, increased shoot length, increased leaf number, increased water use efficiency, increased tolerance to low nitrogen stress, increased nitrogen use efficiency, increased overall biomass, increase grain yield, increased photosynthesis rate, increased tolerance to drought, increased heat tolerance, increased salt tolerance, increased resistance to nematode stress, increased resistance to a fungal pathogen, increased resistance to a bacterial pathogen, increased resistance to a viral pathogen, a detectable modulation in the level of a metabolite, a detectable modulation in gene expression, a detectable modulation in the proteome, and combinations thereof.

In some embodiments of any of the methods described herein, a benefit or plant trait is increased tolerance to low nitrogen stress or increased nitrogen use efficiency, and at least one of the first and second endophyte is non-diazotrophic.

In some embodiments of any of the methods described herein, a benefit or plant trait is increased tolerance to low nitrogen stress or increased nitrogen use efficiency, and at least one of the first and second endophyte is diazotrophic.

In some embodiments of any of the methods described herein, a formulation comprises at least one member selected from the group consisting of an agriculturally compatible carrier, a tackifier, a microbial stabilizer, a fungicide, an antibacterial agent, an herbicide, a nematicide, an insecticide, a plant growth regulator, a rodenticide, a nutrient, and combinations thereof.

In some embodiments of any of the methods described herein, a formulation comprises at least 100 CFU or spores, at least 300 CFU or spores, at least 1,000 CFU or spores, at least 3,000 CFU or spores, at least 10,000 CFU or spores, at least 30,000 CFU or spores, at least 100,000 CFU or spores, at least 300,000 CFU or spores, at least 1,000,000 CFU or spores or more, of each of a first and second endophyte.

In some embodiments of any of the methods described herein, plants comprising or derived from the plant elements are monocots.

In some embodiments of any of the methods described herein, a monocot is selected from the group consisting of maize, rice, wheat, barley, sorghum, and sugarcane.

In some embodiments of any of the methods described herein, plants comprising or derived from the plant elements are dicots.

In some embodiments of any of the methods described herein, a dicot is selected from the group consisting of a cotton, soybean, pepper, rapeseed, canola, and tomato.

In some embodiments of any of the methods described herein, each of a first and second endophyte is present in the formulation in an amount effective to be detectable within a target tissue of the plant selected from a fruit, seed, leaf, root or portion thereof.

In some embodiments of any of the methods described herein, each of the first and second endophyte is detected in an amount of at least 100 CFU or spores, at least 300 CFU or spores, at least 1,000 CFU or spores, at least 3,000 CFU or spores, at least 10,000 CFU or spores, at least 30,000 CFU or spores, at least 100,000 CFU or spores, at least 300,000 CFU or spores, at least 1,000,000 CFU or spores, or more, in a target tissue of the plants comprising or derived from the plant elements.

In some embodiments of any of the methods described herein, the first and second endophytes are present in the formulation in an amount effective to increase the biomass and/or yield of the fruit or seed produced by plants comprising or derived from the plant elements by at least 1%, at least 2%, at least 3%, at least 5%, at least 10%, at least 15%, at least 20%, at least 30%, at least 40%, at least 50%, at least 60%, at least 70%, at least 80%, at least 90%, at least 100%, or more, when compared with the fruit or seed of reference agricultural plants.

In some embodiments of any of the methods described herein, the first and second endophytes are present in the formulation in an amount effective to detectably increase the biomass of the plants comprising or derived from the plant elements, or a part or a tissue type thereof.

In some embodiments of any of the methods described herein, the biomass of the plants comprising or derived from the plant elements, or a part or tissue type thereof is detectably increased by at least 1%, at least 2%, at least 3%, at least 5%, at least 10%, at least 15%, at least 20%, at least 30%, at least 40%, at least 50%, at least 60%, at least 70%, at least 80%, at least 90%, at least 100%, or more, when compared with reference agricultural plants.

In some embodiments of any of the methods described herein, the first and second endophytes are present in the formulation in an amount effective to detectably increase the rate of germination of the seeds. In some embodiments of any of the methods described herein, the trait of agronomic importance is an increase in the rate of germination of the seeds by at least 0.5%, at least 1%, at least 2%, at least 3%, at least 5%, at least 10%, at least 20%, at least 30%, at least 40%, at least 50%, at least 60%, at least 70%, at least 80%, at least 90%, at least 100% or more, when compared with reference agricultural plants.

In some embodiments, disclosed herein are synthetic combinations comprising, a plurality of plant elements and a formulation comprising at least a first and a second endophyte population heterologously disposed to the plant elements, wherein the first endophyte comprises a nucleic acid sequence having at least 97% identity to a nucleic acid sequence selected from column A of a pair of endophytes listed in any of Tables 10-16 and the second endophyte comprises a nucleic acid sequence having at least 97% identity to the nucleic acid sequence selected from column B of the pair, wherein the endophyte populations are present in the formulation in an amount capable of modulating a trait of agronomic importance in plants comprising or derived from said plant elements, as compared to reference isoline plants not comprising or not derived from plant elements inoculated with said formulation. In some embodiments of any of the synthetic combinations described herein, the plurality of plant elements are seeds. In some embodiments of any of the synthetic combinations described herein, the plurality of plant elements are whole plants.

In some embodiments of any of the synthetic combinations described herein, the synthetic combination is disposed within a packaging material selected from a bag, box, bin, envelope, carton, or container. In some embodiments of any of the synthetic combinations described herein, the packaging material optionally comprises a desiccant, and wherein the synthetic combination optionally comprises an antifungal agent.

In some embodiments of any of the synthetic combinations described herein, the first and second endophytes are localized on the surface of the plant elements.

In some embodiments of any of the synthetic combinations described herein, at least one of the first endophyte and the second endophyte is obtained from a plant species other than the plant elements of the synthetic combination.

In some embodiments of any of the synthetic combinations described herein, at least one of the first endophyte and the second endophyte is obtained from a plant cultivar different from the cultivar of the plant elements of the synthetic combination.

In some embodiments of any of the synthetic combinations described herein, at least one of the first endophyte and the second endophyte is obtained from a plant cultivar that is the same as the cultivar of the plant elements of the synthetic combination.

In some embodiments of any of the synthetic combinations described herein, at least one of the first endophyte and the second endophyte is a bacteria of a family selected from the group consisting of: Acetobacteraceae, Acidobacteriaceae, Acidothermaceae, Aerococcaceae, Alcaligenaceae, Alicyclobacillaceae, Alteromonadaceae, Anaerolineaceae, Aurantimonadaceae, Bacillaceae, Bacteriovoracaceae, Bdellovibrionaceae, Bradyrhizobiaceae, Brevibacteriaceae, Brucellaceae, Burkholderiaceae, Carboxydocellaceae, Caulobacteraceae, Cellulomonadaceae, Chitinophagaceae, Chromatiaceae, Chthoniobacteraceae, Chthonomonadaceae, Clostridiaceae, Comamonadaceae, Corynebacteriaceae, Coxiellaceae, Cryomorphaceae, Cyclobacteriaceae, Cytophagaceae, Deinococcaceae, Dermabacteraceae, Dermacoccaceae, Enterobacteriaceae, Enterococcaceae, Erythrobacteraceae, Fibrobacteraceae, Flammeovirgaceae, Flavobacteriaceae, Frankiaceae, Fusobacteriaceae, Gaiellaceae, Gemmatimonadaceae, Geodermatophilaceae, Glycomycetaceae, Haliangiaceae, Halomonadaceae, Holosporaceae, Hyphomicrobiaceae, Iamiaceae, Intrasporangiaceae, Kineosporiaceae, Koribacteraceae, Lachnospiraceae, Lactobacillaceae, Legionellaceae, Leptospiraceae, Leuconostocaceae, Methylobacteriaceae, Methylocystaceae, Methylophilaceae, Microbacteriaceae, Micrococcaceae, Micromonosporaceae, Moraxellaceae, Mycobacteriaceae, Mycoplasmataceae, Myxococcaceae, Nakamurellaceae, Neisseriaceae, Nitrosomonadaceae, Nocardiaceae, Nocardioidaceae, Oceanospirillaceae, Opitutaceae, Oxalobacteraceae, Paenibacillaceae, Parachlamydiaceae, Pasteurellaceae, Patulibacteraceae, Peptostreptococcaceae, Phyllobacteriaceae, Piscirickettsiaceae, Planctomycetaceae, Planococcaceae, Polyangiaceae, Porphyromonadaceae, Prevotellaceae, Promicromonosporaceae, Pseudomonadaceae, Pseudonocardiaceae, Rhizobiaceae, Rhodobacteraceae, Rhodospirillaceae, Roseiflexaceae, Rubrobacteriaceae, Sandaracinaceae, Sanguibacteraceae, Saprospiraceae, Segniliparaceae, Shewanellaceae, Sinobacteraceae, Solibacteraceae, Solimonadaceae, Solirubrobacteraceae, Sphingobacteriaceae, Sphingomonadaceae, Spiroplasmataceae, Sporichthyaceae, Sporolactobacillaceae, Staphylococcaceae, Streptococcaceae, Streptomycetaceae, Syntrophobacteraceae, Veillonellaceae, Verrucomicrobiaceae, Weeksellaceae, Xanthobacteraceae, and Xanthomonadaceae.

In some embodiments of any of the synthetic combinations described herein, at least one of the first endophyte and the second endophyte is a fungus of a family selected from the group consisting of: Aspergillaceae, Ceratobasidiaceae, Coniochaetaceae, Cordycipitaceae, Corticiaceae, Cystofilobasidiaceae, Davidiellaceae, Debaryomycetaceae, Dothioraceae, Erysiphaceae, Filobasidiaceae, Glomerellaceae, Hydnaceae, Hypocreaceae, Leptosphaeriaceae, Montagnulaceae, Mortierellaceae, Mycosphaerellaceae, Nectriaceae, Orbiliaceae, Phaeosphaeriaceae, Pleosporaceae, Pseudeurotiaceae, Rhizopodaceae, Sclerotiniaceae, Stereaceae, and Trichocomaceae.

In some embodiments of any of the synthetic combinations described herein, the first endophyte comprises a nucleic acid sequence having at least 97% identity to SEQ ID: 1106 and the second endophyte is selected from the genus *Citrobacter*.

In some embodiments of any of the synthetic combinations described herein, the first endophyte comprises a nucleic acid sequence having at least 97% identity to SEQ ID: 1695 and the second endophyte is selected from the family Enterobacteriaceae.

In some embodiments of any of the synthetic combinations described herein, the first endophyte comprises a nucleic acid sequence having at least 97% identity to SEQ ID: 1695 and the second endophyte is selected from the genus *Citrobacter*.

In some embodiments of any of the synthetic combinations described herein, the first endophyte comprises a nucleic acid sequence having at least 97% identity to SEQ ID: 1106 and the second endophyte comprises a nucleic acid sequence having at least 97% identity to SEQ ID: 1098.

In some embodiments of any of the synthetic combinations described herein, the first endophyte comprises a nucleic acid sequence having at least 97% identity to SEQ ID: 1695 and the second endophyte comprises a nucleic acid sequence having at least 97% identity to SEQ ID: 1098.

In some embodiments of any of the synthetic combinations described herein, the first endophyte comprises a nucleic acid sequence having at least 97% identity to SEQ ID: 1695 and the second endophyte comprises a nucleic acid sequence having at least 97% identity to SEQ ID: 1702, SEQ ID: 1698, or SEQ ID: 1700.

In some embodiments of any of the synthetic combinations described herein, the first endophyte comprises a nucleic acid sequence having at least 97% identity to SEQ ID: 1695 and the second endophyte comprises a nucleic acid sequence having at least 97% identity to SEQ ID: 1702

In some embodiments of any of the synthetic combinations described herein, each of the first and second endophytes is independently capable of at least one of production of an auxin, nitrogen fixation, production of an antimicrobial, production of a siderophore, mineral phosphate solubilization, production of a cellulase, production of a chitinase, production of a xylanase, production of acetoin, or combinations thereof.

In some embodiments of any of the synthetic combinations described herein, each of the first and second endophytes is independently capable of at least two of: production of an auxin, nitrogen fixation, production of an antimicrobial, production of a siderophore, mineral phosphate solubilization, production of a cellulase, production of a chitinase, production of a xylanase, utilization of arabinose as a carbon source, production of acetoin, or combinations thereof.

In some embodiments of any of the synthetic combinations described herein, each of the first and second endophytes is independently capable of metabolizing at least one of D-alanine, D-aspartic acid, D-serine, D-threonine, glycyl-L-aspartic acid, glycyl-L-glutamic acid, glycyl-L-proline, glyoxylic acid, inosine, L-alanine, L-alanyl-glycine, L-arabinose, L-asparagine, L-aspartic acid, L-glutamic acid, L-glutamine, L-proline, L-serine, L-threonine, tyramine, uridine, proline, arabinose, xylose, mannose, sucrose, maltose, D-glucosamine, trehalose, oxalic acid, salicin, or combinations thereof.

In some embodiments of any of the synthetic combinations described herein, each of the first and second endophytes is independently capable of metabolizing at least two of D-alanine, D-aspartic acid, D-serine, D-threonine, glycyl-L-aspartic acid, glycyl-L-glutamic acid, glycyl-L-proline, glyoxylic acid, inosine, L-alanine, L-alanyl-glycine, L-arabinose, L-asparagine, L-aspartic acid, L-glutamic acid, L-glutamine, L-proline, L-serine, L-threonine, tyramine, uridine, proline, arabinose, xylose, mannose, sucrose, maltose, D-glucosamine, trehalose, oxalic acid, salicin, or combinations thereof.

In some embodiments of any of the synthetic combinations described herein, the trait of agronomic importance is selected from the group consisting of: disease resistance, heat tolerance, drought tolerance, water use efficiency, cold tolerance, salinity tolerance, metal tolerance, herbicide tolerance, chemical tolerance, nitrogen utilization, nutrient utilization, resistance to nitrogen stress, nitrogen fixation, pathogen resistance, insect resistance, yield, yield under water-limited conditions, grain weight, fruit weight, kernel moisture content, number of ears, number of kernels per ear, health enhancement, vigor, growth, photosynthetic capability, nutrition enhancement, altered protein content, altered oil content, biomass, root biomass, root length, root surface area, root architecture, shoot length, shoot height, shoot biomass, seed weight, seed carbohydrate composition, seed oil composition, number of pods, delayed senescence, stay-green, seed protein composition, dry weight of mature seeds, fresh weight of mature seeds, number of mature seeds per plant, number of flowers per plant, chlorophyll content, rate of photosynthesis, number of leaves, number of pods per plant, length of pods per plant, number of wilted leaves per plant, number of severely wilted leaves per plant, number of non-wilted leaves per plant, resistance to a fungal pathogen, resistance to a bacterial pathogen, resistance to a viral pathogen, resistance to a nematode, a detectable modulation in the level of a metabolite, a detectable modulation in gene expression, a detectable modulation in the proteome, and combinations thereof.

In some embodiments of any of the synthetic combinations described herein, the benefit comprises at least two benefits selected from the group consisting of: disease resistance, heat tolerance, drought tolerance, water use efficiency, cold tolerance, salinity tolerance, metal tolerance, herbicide tolerance, chemical tolerance, improved nitrogen utilization, improved nitrogen use efficiency, resistance to nitrogen stress, increased tolerance to low nitrogen stress, improved nitrogen fixation, pest resistance, herbivore resistance, pathogen resistance, increased yield, health enhancement, vigor improvement, growth improvement, photosynthetic capability improvement, nutrition enhancement, altered protein content, altered oil content, increased biomass, increased root biomass, increased root length, increased root surface area, improved root architecture, increased shoot length, increased shoot height, increased shoot biomass, increased seed weight, altered seed carbohydrate composition, altered seed oil composition, increased number of pods, delayed senescence, stay-green, altered seed protein composition, increased dry weight of mature seeds, increased fresh weight of mature seeds, increased number of mature seeds per plant, increased chlorophyll content, increased photosynthesis rate, increased number of leaves, increased number of pods per plant, increased length of pods per plant, reduced number of wilted leaves per plant, reduced number of severely wilted leaves per plant, increased number of non-wilted leaves per plant, increased resistance to a fungal pathogen, increased resistance to a bacterial pathogen, increased resistance to a viral pathogen, increased resistance to a nematode, a detectable modulation in the level of a metabolite, a detectable modulation in gene expression, a detectable modulation in the proteome, and combinations thereof.

In some embodiments of any of the synthetic combinations described herein, the first and second endophytes are heterologously disposed as a coating on the surface of the seeds.

In some embodiments of any of the synthetic combinations described herein, the plurality of plant elements are seedlings and the first and second endophyte populations are heterologously disposed on the seedlings as a spray applied to one or more leaves and/or one or more roots of the seedlings.

In some embodiments of any of the synthetic combinations described herein, each of the first and second endophytes is present in the formulation at least $1\times10^3$ CFU or spores/ml. In some embodiments of any of the synthetic combinations described herein, the effective amount is from about $1\times10^2$ CFU or spores/per seed to about $1\times10^8$ CFU or spores/per seed. In some embodiments of any of the synthetic combinations described herein, the first endophyte is present in the formulation in an amount of at least about 100 CFU or spores, at least 300 CFU or spores, at least 1,000 CFU or spores, at least 3,000 CFU or spores, at least 10,000 CFU or spores, at least 30,000 CFU or spores, at least 100,000 CFU or spores, at least 300,000 CFU or spores, at least 1,000,000 CFU spores per ml.

In some embodiments of any of the synthetic combinations described herein, the synthetic combination further comprises one or more of the following: a stabilizer, or a preservative, or a carrier, or a surfactant, or an anticomplex agent, or any combination thereof. In some embodiments of any of the synthetic combinations described herein, the synthetic combination further comprises one or more of the following: a fungicide, nematicide, a bactericide, a insecticide, a herbicide, or any combination thereof.

In some embodiments of any of the synthetic combinations described herein, the plants comprising or derived from the plant elements are modified. In some embodiments of any of the synthetic combinations described herein, the plants comprising or derived from the plant elements are modified and the plant elements are seeds.

In some embodiments of any of the synthetic combinations described herein, the plants comprising or derived from the plant elements are monocots. In some embodiments a monocot of the synthetic combinations described herein is selected from the group consisting of maize, rice, wheat, barley, sorghum, and sugarcane. In some embodiments of any of the synthetic combinations described herein, the plants comprising or derived from the plant elements are dicots. In some embodiments a dicot of the synthetic combinations described herein is selected from the group consisting of cotton, soybean, pepper, rapeseed, canola, and tomato.

In some embodiments of any of the synthetic combinations described herein, plant elements are placed in a medium that promotes plant growth. In some embodiments of any of the synthetic combinations described herein, the medium that promotes plant growth is selected from the group consisting of: soil, hydroponic apparatus, and artificial growth medium. In some embodiments of any of the synthetic combinations described herein, the plant elements are seeds and are placed in the soil in rows, with substantially equal spacing between each seed within each row.

In some embodiments of any of the synthetic combinations described herein, plant elements are confined within an object selected from the group consisting of: bottle, jar, ampule, package, vessel, bag, box, bin, envelope, carton, container, silo, shipping container, truck bed, and case.

In some embodiments of any of the synthetic combinations described herein, the synthetic combination is shelf-stable.

In some embodiments of any of the synthetic combinations described herein, the plurality of plant elements are seeds and the synthetic combination is shelf-stable.

In some embodiments a plant grown from the synthetic combinations described herein, exhibits an improved phenotype selected from the group consisting of: increased germination rate, increased disease resistance, increased heat tolerance, increased drought tolerance, increased water use efficiency, increased cold tolerance, increased salinity tolerance, increased metal tolerance, increased herbicide tolerance, increased chemical tolerance, increased nitrogen utilization, increased nitrogen use efficiency, resistance to nitrogen stress, increased tolerance to low nitrogen stress, improved nitrogen fixation, increased pest resistance, increased herbivore resistance, increased pathogen resistance, increased insect resistance, increased yield, increased yield under water-limited conditions, increased grain or fruit mass, kernel moisture content, increased number of ears, increased number of kernels per ear, health enhancement, increased vigor improvement, growth improvement, photosynthetic capability improvement, nutrition enhancement, altered protein content, altered oil content, increased biomass, increased root biomass, increased root length, increased root surface area, improved root architecture, increased shoot length, increased shoot height, increased shoot biomass, increased seed weight, altered seed carbohydrate composition, altered seed oil composition, increased number of pods, delayed senescence, stay-green, altered seed protein composition, increased dry weight of mature seeds, increased fresh weight of mature seeds, increased number of mature seeds per plant, increased chlorophyll content, increased photosynthesis rate, increased number of leaves, increased number of pods per plant, increased length of pods per plant, reduced number of wilted leaves per plant, reduced number of severely wilted leaves per plant, increased number of non-wilted leaves per plant, increased resistance to a fungal pathogen, increased resistance to a bacterial pathogen, increased resistance to a viral pathogen, increased resistance to a nematode, a detectable modulation in the level of a metabolite, a detectable modulation in gene expression, and a detectable modulation in the proteome.

In some embodiments a plant grown from any of the synthetic combinations described herein or progeny of a plant grown from any of the synthetic combinations described herein, comprise in at least one of its plant elements each of the first and second endophytes.

In some embodiments agricultural products described herein comprise a 1000 seed weight amount of a synthetic combination.

In some embodiments agricultural products described herein comprise each of the first and second endophytes present in a concentration of from about $10^2$ to about $10^5$ CFU or spores/seed.

In some embodiments of the agricultural products described herein each of the first and second endophytes are present in a concentration is from about $10^5$ to about $10^8$ CFU or spores/seed.

In some embodiments of the commodity plant products described herein, the commodity plant products comprise or are derived from a synthetic composition and a plant or plant element is a monocot, selected from the group consisting of maize, rice, wheat, barley, sorghum, and sugarcane.

In some embodiments of the commodity plant products described herein, the commodity plant products comprise or are derived from a synthetic composition and a plant or plant element is a dicot, selected from the group consisting of cotton, soybean, pepper, rapeseed, canola, and tomato.

In some embodiments of the commodity plant products described herein, the commodity plant products comprise or are derived from a synthetic composition and the plant or plant element exhibits an improved phenotype selected from the group consisting of: increased germination rate, increased disease resistance, increased heat tolerance, increased drought tolerance, increased water use efficiency, increased cold tolerance, increased salinity tolerance, increased metal tolerance, increased herbicide tolerance, increased chemical tolerance, increased nitrogen utilization, increased nitrogen use efficiency, resistance to nitrogen stress, increased tolerance to low nitrogen stress, improved nitrogen fixation, increased pest resistance, increased herbivore resistance, increased pathogen resistance, increased insect resistance, increased yield, increased yield under water-limited conditions, increased grain or fruit mass, kernel moisture content, increased number of ears, increased number of kernels per ear, health enhancement, increased vigor improvement, growth improvement, photosynthetic capability improvement, nutrition enhancement, altered protein content, altered oil content, increased biomass, increased root biomass, increased root length, increased root surface area, improved root architecture, increased shoot length, increased shoot height, increased shoot biomass, increased seed weight, altered seed carbohydrate composition, altered seed oil composition, increased number of pods, delayed senescence, stay-green, altered seed protein composition, increased dry weight of mature seeds, increased fresh weight of mature seeds, increased number of mature seeds per plant, increased chlorophyll content, increased photosynthesis rate, increased number of leaves, increased number of pods per plant, increased length of pods per plant, reduced number of wilted leaves per plant, reduced number of severely wilted leaves per plant, increased number of non-wilted leaves per plant, increased resistance to a fungal pathogen, increased resistance to a bacterial pathogen, increased resistance to a viral pathogen, increased resistance to a nematode, a detectable modulation in the level of a metabolite, a detectable modulation in gene expression, a detectable modulation in the proteome, or combinations thereof.

In some embodiments, the commodity plant product described herein is a grain, a flour, a starch, a syrup, a meal, an oil, a film, a packaging, a nutraceutical product, a pulp, an animal feed, a fish fodder, a bulk material for industrial chemicals, a cereal product, a processed human-food product, a sugar or an alcohol and protein.

In some embodiments, disclosed herein are methods of producing a commodity plant product, comprising (a) obtaining a plant or plant tissue from any of the plants disclosed herein, or progeny or derivative thereof, and (b) producing the commodity plant product therefrom.

In some embodiments of any of the methods described herein, the first endophyte comprises a nucleic acid sequence having at least 97% identity to SEQ ID: 1106 and the second endophyte is selected from the family Enterobacteriaceae.

In some embodiments of any of the methods described herein, the first endophyte comprises a nucleic acid sequence having at least 97% identity to SEQ ID: 1106 and the second endophyte is selected from the genus *Citrobacter*.

In some embodiments of any of the methods described herein, the first endophyte comprises a nucleic acid sequence having at least 97% identity to SEQ ID: 1695 and the second endophyte is selected from the family Enterobacteriaceae.

In some embodiments of any of the methods described herein, the first endophyte comprises a nucleic acid sequence having at least 97% identity to SEQ ID: 1695 and the second endophyte is selected from the genus *Citrobacter*.

In some embodiments of any of the methods described herein, the first endophyte comprises a nucleic acid sequence having at least 97% identity to SEQ ID: 1106 and the second endophyte comprises a nucleic acid sequence having at least 97% identity to SEQ ID: 1098.

In some embodiments of any of the methods described herein, the first endophyte comprises a nucleic acid sequence having at least 97% identity to SEQ ID: 1695 and the second endophyte comprises a nucleic acid sequence having at least 97% identity to SEQ ID: 1098.

In some embodiments of any of the methods described herein, the first endophyte comprises a nucleic acid sequence having at least 97% identity to SEQ ID: 1695 and the second endophyte comprises a nucleic acid sequence having at least 97% identity to SEQ ID: 1702, SEQ ID: 1698, or SEQ ID: 1700.

In some embodiments of any of the methods described herein, the first endophyte comprises a nucleic acid sequence having at least 97% identity to SEQ ID: 1695 and the second endophyte comprises a nucleic acid sequence having at least 97% identity to SEQ ID: 1702.

DESCRIPTION OF THE DRAWINGS

FIG. 4A: Corn seedlings treated with only MIC-54210. FIG. 4B: Corn seedlings treated with only MIC-77594. FIG. 4C: Corn seedlings not treated with a microbe. FIG. 4D: Corn seedlings treated with MIC-54210 and MIC-77594.

FIG. 5A: Corn seedlings treated with only MIC-68866. FIG. 5B: Corn seedlings treated with only MIC-77594. FIG. 5C: Corn seedlings not treated with a microbe. FIG. 5D: Corn seedlings treated with MIC-68866 and MIC-77594.

FIG. 6A: Corn seedlings grown as described in Example 19 except water was substituted for the water/PEG solution. FIG. 6B: Corn seedlings grown in water limited conditions as described in Example 19.

DEFINITIONS

Figure 1:
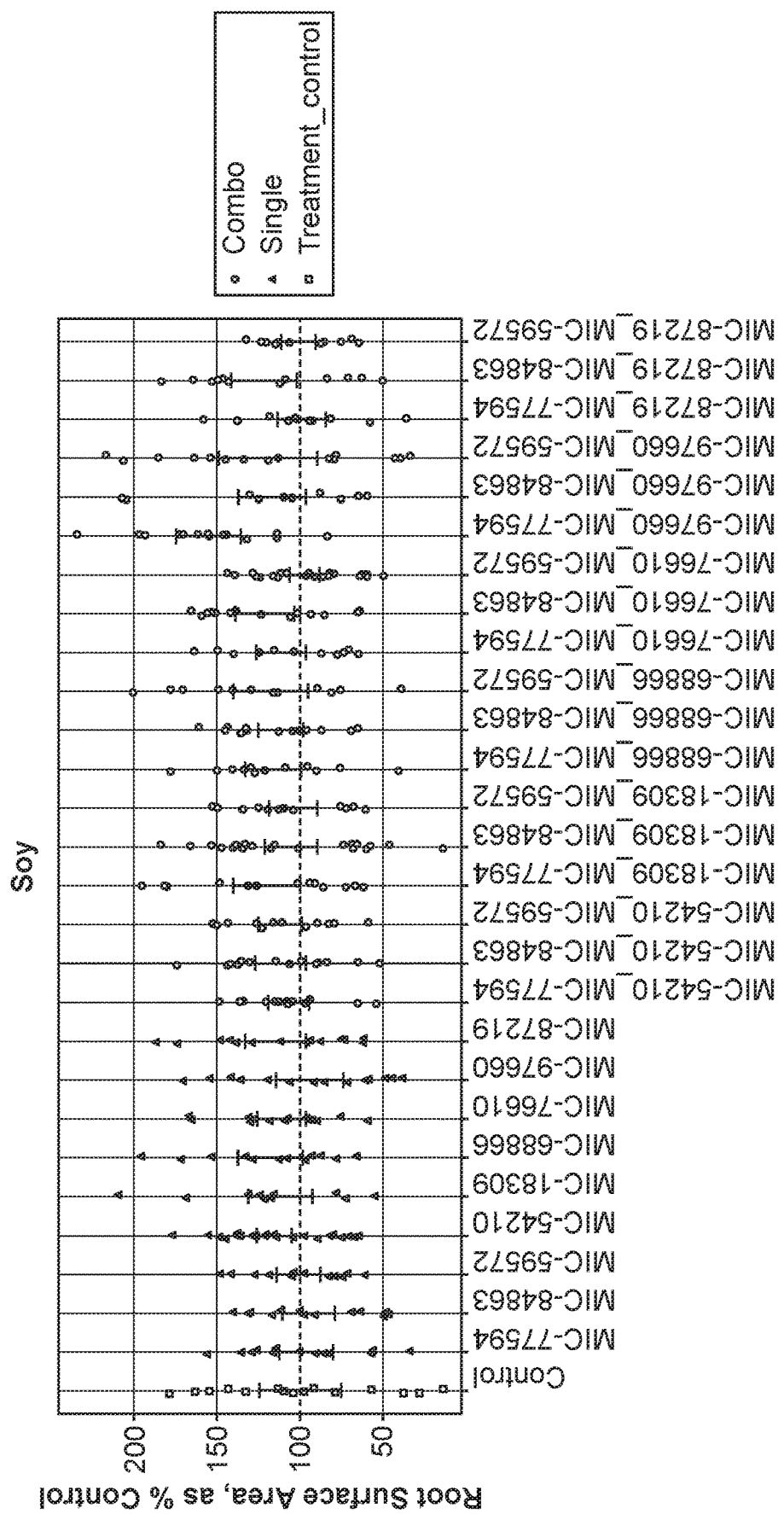
FIG. 1: Root surface area ($cm^2$) of soybean seedlings grown in water limited conditions as percentage of the average root surface area of control soybean seedlings not treated with a microbe. Seedlings were grown in water limited conditions as described in Example 18.
Figure 2:
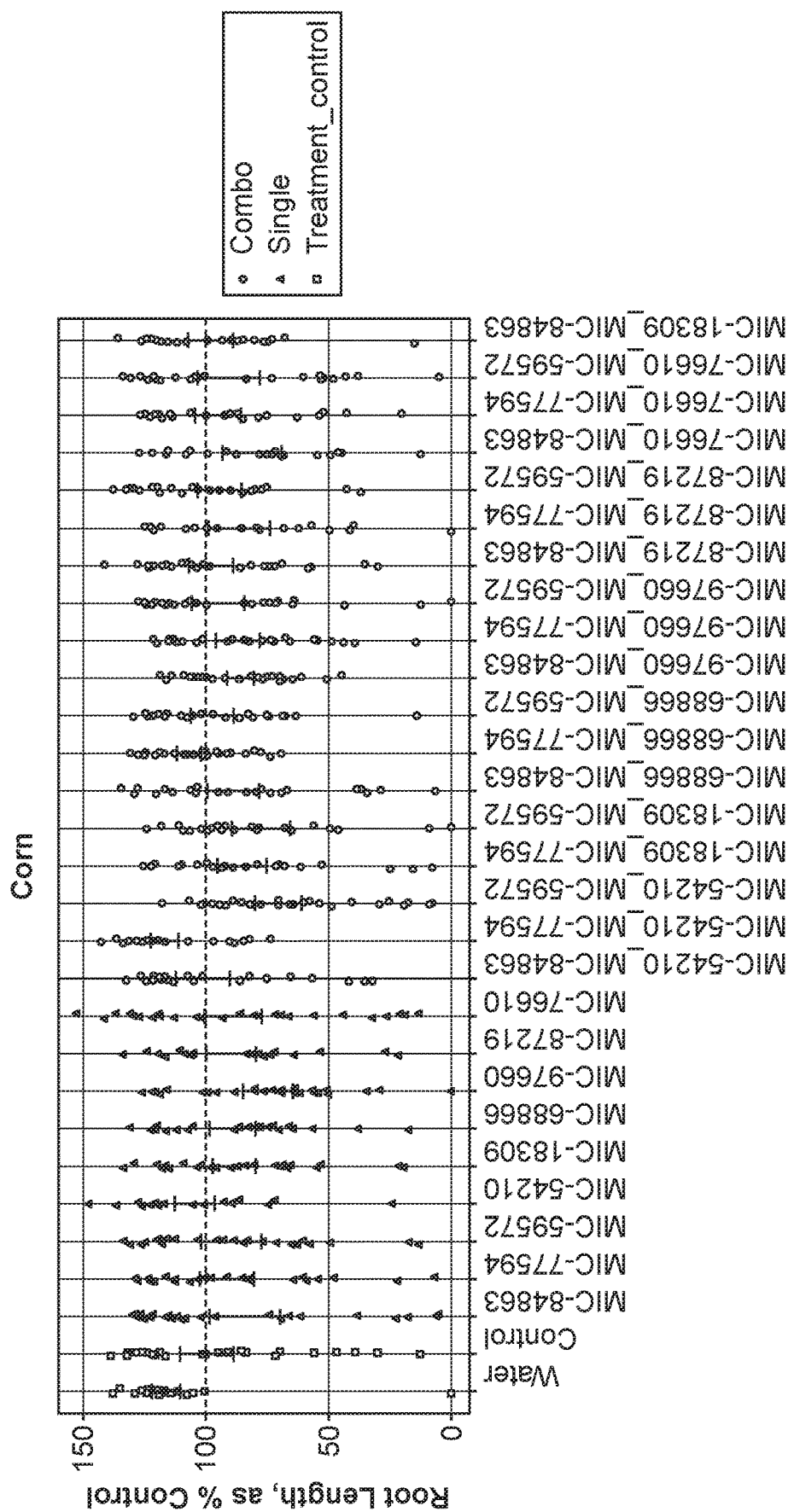
FIG. 2: Root length (cm) of corn seedlings grown in water limited conditions as percentage of the average root length of control corn seedlings not treated with a microbe. Seedlings were grown in water limited conditions as described in Example 19.
Figure 3:
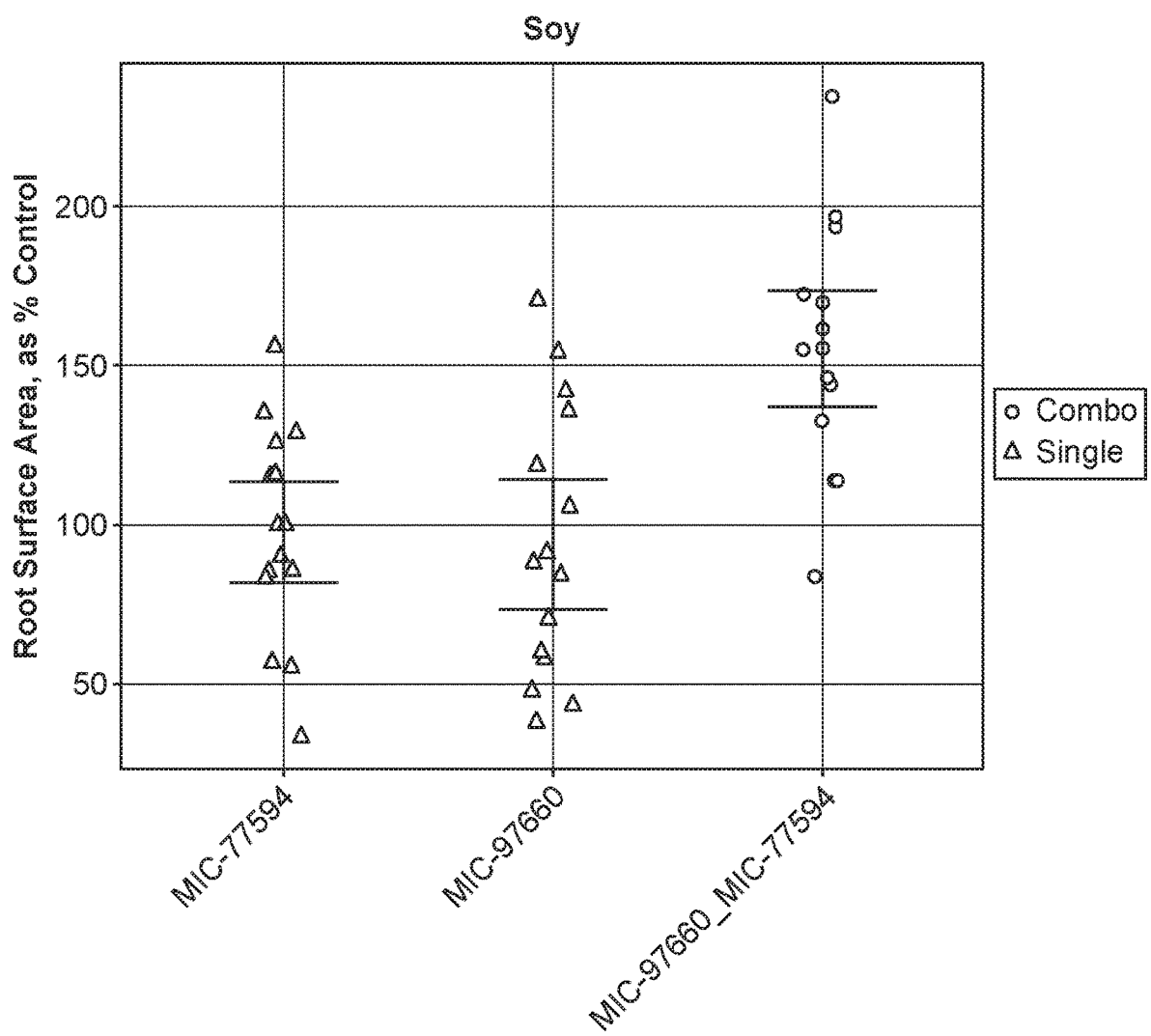
FIG. 3: Root surface area ($cm^2$) of soybean seedlings grown in water limited conditions as percentage of the average root surface area of soybean seedlings not treated with a microbe, where seeds were treated with MIC-97660, MIC-77594 or both MIC-97660 and MIC-77594. Seedlings were grown in water limited conditions as described in Example 18.
Figure 4A:
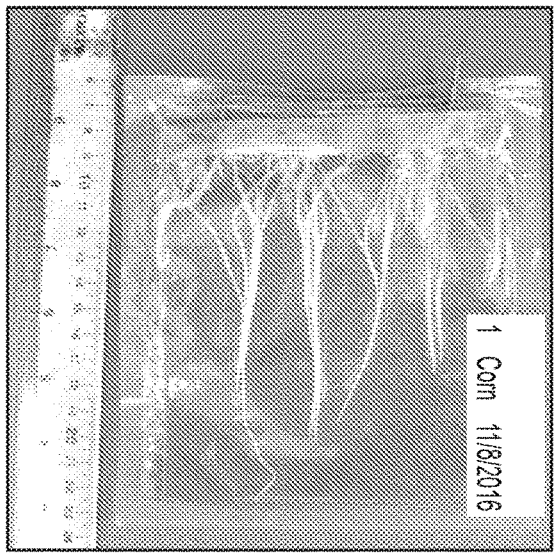
FIG. 4A and FIG. 4B and FIG. 4C and FIG. 4D represent exemplary corn seedlings grown in water limited conditions as described in Example 19.
Figure 4B:
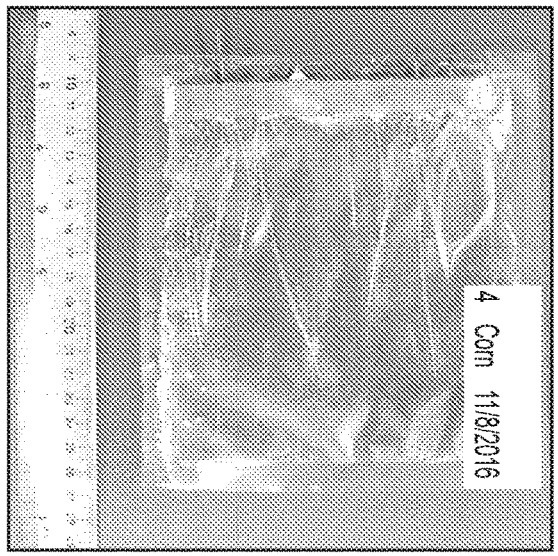
Figure 4C:
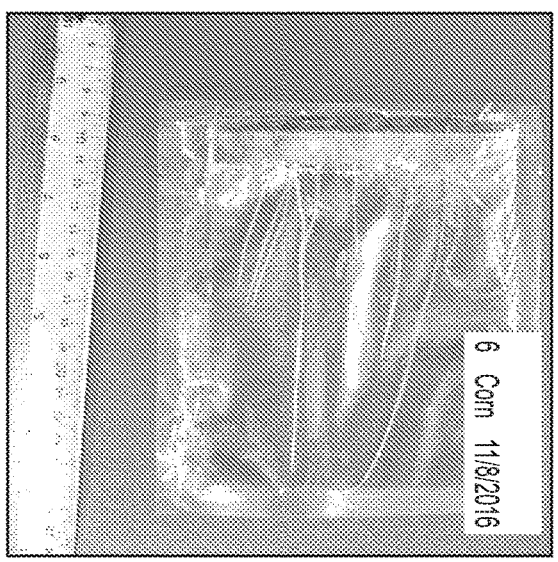
Figure 4D:
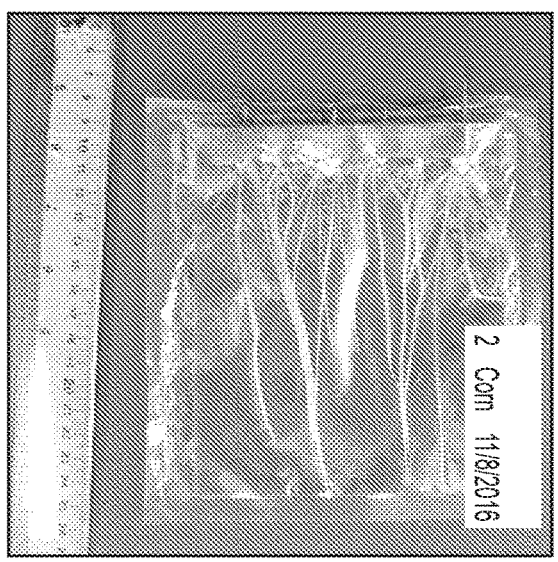
Figure 5A:
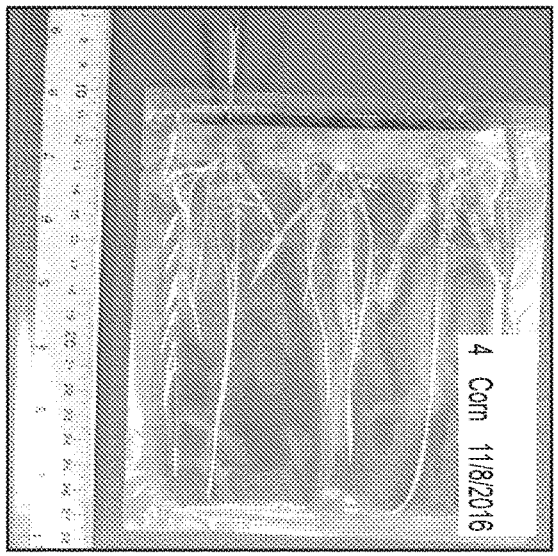
FIG. 5A and FIG. 5B and FIG. 5C and FIG. 5D represent exemplary corn seedlings grown in water limited conditions as described in Example 19.
Figure 5B:
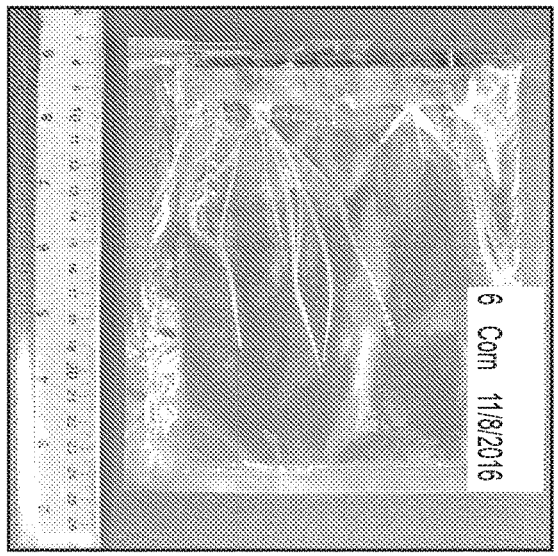
Figure 5C:
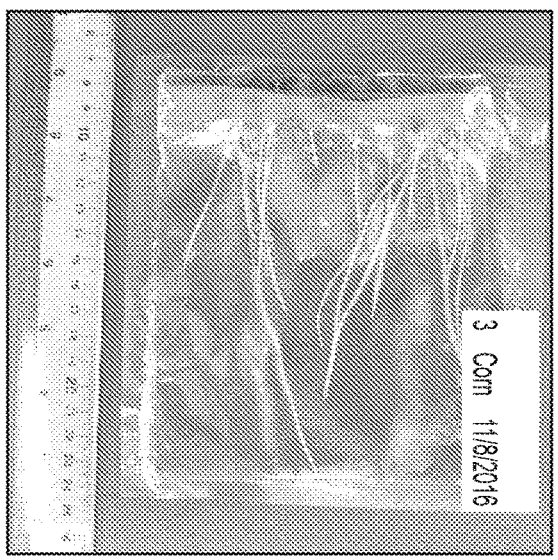
Figure 5D:
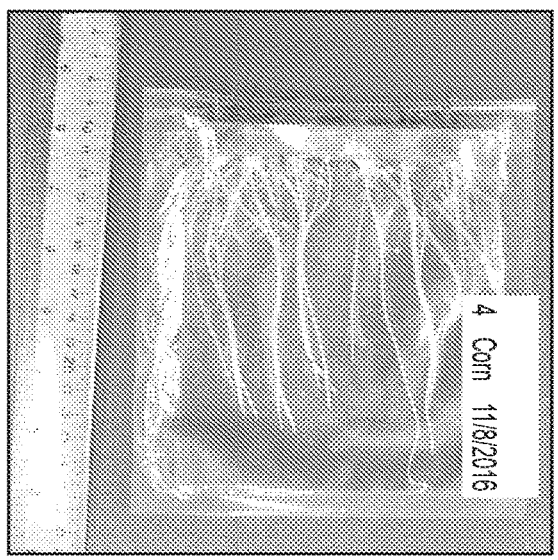
Figure 6A:
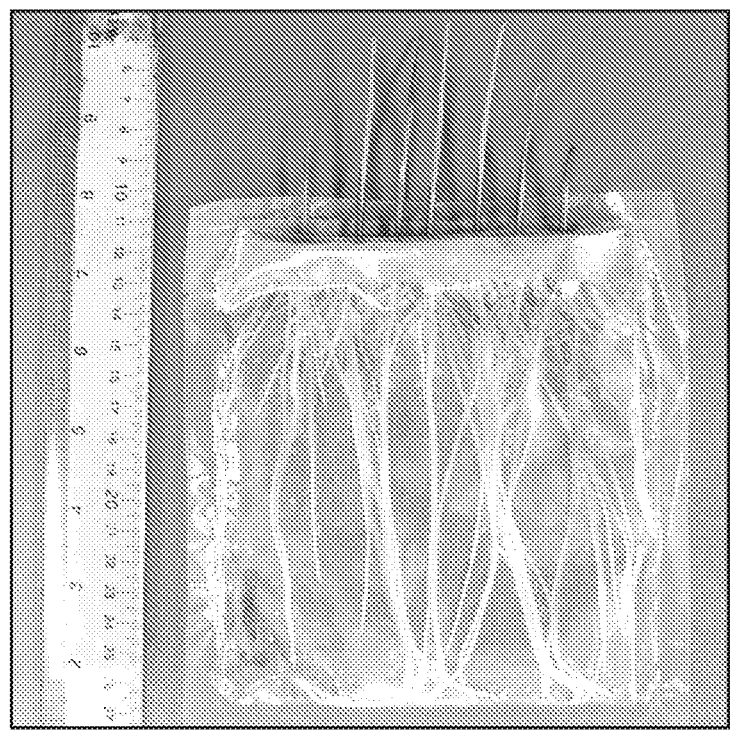
FIG. 6A and FIG. 6B exemplify the effect of water limited conditions on corn seedlings growth.
Figure 6B:

Terms used in the claims and specification are defined as set forth below unless otherwise specified.

As used herein, a "synthetic combination" is the combination of a plant element, seedling, or whole plants and a plurality of endophytes, combined by human endeavor, in which one or more of the plurality of endophytes are heterologously disposed, said combination which is not found in nature. In some embodiments, the synthetic combination includes two or more endophytes that synergistically interact providing a benefit to an agricultural seed, seedling, or plant derived thereby. In some embodiments, a synthetic combination is used to refer to a treatment formulation comprising an isolated, purified population of endophytes heterologously disposed to a plant element. In some embodiments of the present invention, "synthetic combination" refers to a purified population of endophytes in a treatment formulation comprising additional compositions with which said endophytes are not found associated in nature.

As used herein, an endophyte is "heterologously disposed" when mechanically or manually applied, artificially inoculated or disposed onto or into a plant element, seedling, plant or onto or into a plant growth medium or onto or into a treatment formulation so that the endophyte exists on or in said plant element, seedling, plant, plant growth medium, or treatment formulation in a manner not found in nature prior to the application of the endophyte, e.g., said combination which is not found in nature. In some embodiments, such a manner is contemplated to include: the presence of the endophyte; presence of the endophyte in a different number, concentration, or amount; the presence of the endophyte in or on a different plant element, tissue, cell type, or other physical location in or on the plant; the presence of the endophyte at different time period, e.g. developmental phase of the plant or plant element, time of day, time of season, and combinations thereof. In some embodiments, plant growth medium is soil, a hydroponic apparatus, or artificial growth medium such as commercial potting mix. In some embodiments, the plant growth medium is soil in an agricultural field. In some embodiments, the plant growth medium is commercial potting mix. In some embodiments, the plant growth medium is an artificial growth medium such as germination paper. As a non-limiting example, if the plant element or seedling or plant has an endophyte normally found in the root tissue but not in the leaf tissue, and the endophyte is applied to the leaf, the endophyte would be considered to be heterologously disposed. As a non-limiting example, if the endophyte is naturally found in the mesophyll layer of leaf tissue but is applied to the epithelial layer, the endophyte would be considered to be heterologously disposed. As a non-limiting example, an endophyte is heterologously disposed at a concentration that is at least 1.5 times, between 1.5 and 2 times, 2 times, between 2 and 3 times, 3 times, between 3 and 5 times, 5 times, between 5 and 7 times, 7 times, between 7 and 10 times, 10 times greater, or even greater than 10 times higher number, amount, or concentration than that which is naturally present. As a non-limiting example, an endophyte is heterologously disposed on a seedling if that endophyte is normally found at the flowering stage of a plant and not at a seedling stage.

As used herein, an "agricultural seed" is a seed used to grow a plant typically used in agriculture (an "agricultural plant"). The seed may be of a monocot or dicot plant, and may be planted for the production of an agricultural product, for example grain, food, feed, fiber, fuel, etc. As used herein, an agricultural seed is a seed that is prepared for planting, for example, in farms for growing.

An "endophyte" is an organism capable of living on a plant or plant element (e.g. rhizoplane or phylosphere), or within a plant or plant element, or on a surface in close physical proximity with a plant or plant element, e.g. within the rhizosphere, without causing disease or harm to the plant. Endophytes can occupy the intracellular or extracellular spaces of plant tissue, including the leaves, stems, flowers, fruits, seeds, or roots. An endophyte can confer a beneficial property to the host plant, including but not limited to, an increase in yield, biomass, resistance, or fitness. In some embodiments, an endophyte can be a fungus, or a bacterium.

As used herein, the term "microbe" or "microorganism" refers to any species or taxon of microorganism, including, but not limited to, archaea, bacteria, microalgae, fungi (including mold and yeast species), mycoplasmas, microspores, nanobacteria, oomycetes, and protozoa. In some embodiments, a microbe or microorganism is an endophyte. In some embodiments, a microbe or microorganism encompasses individual cells (e.g., unicellular microorganisms) or more than one cell (e.g., multi-cellular microorganism). A "population of microorganisms" may thus refer to multiple propagules of a single microorganism. In some embodiments, a microbe or microorganism is modified.

As used herein, a microbe or plant or plant element is "modified" when it comprises an artificially introduced genetic or epigenetic modification. In some embodiments, the modification is introduced by a genome engineering technology. In some embodiments, the modification is introduced by a targeted nuclease. In some embodiments, targeted nucleases include, but are not limited to, Transcription Activator-Like Effector Nuclease (TALEN), zinc finger nuclease (ZNF), Clustered Regulatory Interspaced Short Palindromic Repeats (CRISPR), CRISPR/Cas9, CRISPR/CPF1, and combinations thereof. In some embodiments, the modification is an epigenetic modification. In some embodiments, the modification is introduced by treatment with a DNA methyltransferase inhibitor such as 5-azacytidine, or a histone deacetylase inhibitor such as trichostatin A. In some embodiments, the modification is introduced via tissue culture. In some embodiments, a modified microbe or plant or plant element comprises a transgene.

As used herein, the term "bacteria" or "bacterium" refers in general to any prokaryotic organism, and may reference an organism from either Kingdom Eubacteria (Bacteria), Kingdom Archaebacteria (Archae), or both. In some cases, bacterial genera have been reassigned due to various reasons (such as but not limited to the evolving field of whole genome sequencing), and it is understood that such nomenclature reassignments are within the scope of any claimed genus. For example, certain species of the genus *Erwinia* have been described in the literature as belonging to genus *Pantoea* (Zhang, Y. & Qiu, S. Antonie van Leeuwenhoek (2015) 108: 1037).

As used herein, the term "fungus" or "fungi" refers in general to any organism from Kingdom Fungi. Historical taxonomic classification of fungi has been according to morphological presentation. Beginning in the mid-1800's, it was recognized that some fungi have a pleomorphic life cycle, and that different nomenclature designations were being used for different forms of the same fungus. In 1981, the Sydney Congress of the International Mycological Association laid out rules for the naming of fungi according to their status as anamorph, teleomorph, or holomorph (Taylor J W. One Fungus=One Name: DNA and fungal nomenclature twenty years after PCR. IMA Fungus 2(2):113-120. 2011.). With the development of genomic sequencing, it became evident that taxonomic classification based on molecular phylogenetics did not align with morphological-based nomenclature (Shenoy B D, Jeewon R, Hyde K D. Impact of DNA sequence-data on the taxonomy of anamorphic fungi. In: Fungal Diversity, 2007). As a result, in 2011 the International Botanical Congress adopted a resolution approving the International Code of Nomenclature for Algae, Fungi, and Plants (Melbourne Code) (2012), with the stated outcome of designating "One Fungus=One Name" (Hawksworth D L. Managing and coping with names of pleomorphic fungi in a period of transition. IMA Fungus 3(1):15-24. 2012.). However, systematics experts have not aligned on common nomenclature for all fungi, nor are all existing databases and information resources inclusive of updated taxonomies. As such, many fungi referenced herein may be described by their anamorph form but it is understood that based on identical genomic sequencing, any pleomorphic state of that fungus may be considered to be the same organism. For example, the genus *Alternaria* is the anamorph form of the teleomorph genus *Lewia* (Kwasna H and Kosiak B. *Lewia avenicola* sp. nov. and its *Alternaria* anamorph from oat grain, with a key to the species of *Lewia*. Mycol Res 2003; 107(Pt 3):371-6.), ergo both would be understood to be the same organism with the same DNA sequence. For example, it is understood that the genus *Acremonium* is also reported in the literature as genus *Sarocladium* as well as genus *Tilachilidium* (Summerbell R. C., C. Gueidan, H-J. Schroers3, G. S. de Hoog, M. Starink, Y. Arocha Rosete, J. Guarro and J. A. Scott. *Acremonium* phylogenetic overview and revision of *Gliomastix, Sarocladium*, and *Trichothecium*. Studies in Mycology 68: 139-162. 2011.). For example, the genus *Cladosporium* is an anamorph of the teleomorph genus *Davidiella* (Bensch K, Braun U, Groenewald J Z, Crous P W. The genus *Cladosporium*. Stud Mycol. 2012 Jun. 15; 72(1): 1-401.), and is understood to describe the same organism. In some cases, fungal genera have been reassigned due to various reasons, and it is understood that such nomenclature reassignments are within the scope of any claimed genus.

A "spore" or a population of "spores" refers to bacteria or fungi that are generally viable, more resistant to environmental influences such as heat and bactericidal or fungicidal agents than other forms of the same bacteria or fungi, and typically capable of germination and out-growth. Bacteria and fungi that are "capable of forming spores" are those bacteria and fungi comprising the genes and other necessary abilities to produce spores under suitable environmental conditions.

A "plurality of endophytes" means two or more types of endophyte entities, e.g., of bacteria or fungi, or combinations thereof. In some embodiments, the two or more types of endophyte entities are two or more strains of endophytes. In other embodiments, the two or more types of endophyte entities are two or more species of endophytes. In yet other embodiments, the two or more types of endophyte entities are two or more genera of endophytes. In yet other embodiments, the two or more types of endophyte entities are two or more families of endophytes. In yet other embodiments, the two or more types of endophyte entities are two or more orders of endophytes.

A "population" of endophytes refers to a plurality of propagules of a single endophyte.

A "complex network" means a plurality of endophytes co-localized in an environment, such as on or within an agricultural plant. Preferably, a complex network includes two or more types of endophyte entities that synergistically interact, such synergistic endophytic populations capable of providing a benefit to the agricultural seed, seedling, or plant derived thereby.

The terms "pathogen" and "pathogenic" in reference to a bacterium or fungus includes any such organism that is capable of causing or affecting a disease, disorder or condition of a host comprising the organism.

As used herein, a "colony-forming unit" ("CFU") is used as a measure of viable microorganisms in a sample. A CFU is an individual viable cell capable of forming on a solid medium a visible colony whose individual cells are derived by cell division from one parental cell.

The term "isolated" is intended to specifically reference an organism, cell, tissue, polynucleotide, or polypeptide that is removed from its original source.

As used herein, an isolated strain of a microbe is a strain that has been removed from its natural milieu. "Pure cultures" or "isolated cultures" are cultures in which the organisms present are only of one strain of a particular genus and species. This is in contrast to "mixed cultures," which are cultures in which more than one genus and/or species of microorganism are present. As such, the term "isolated" does not necessarily reflect the extent to which the microbe has been purified. A "substantially pure culture" of the strain of microbe refers to a culture which contains substantially no other microbes than the desired strain or strains of microbe. In other words, a substantially pure culture of a strain of microbe is substantially free of other contaminants, which can include microbial contaminants. Further, as used herein, a "biologically pure" strain is intended to mean the strain separated from materials with which it is normally associated in nature. A strain associated with other strains, or with compounds or materials that it is not normally found with in nature, is still defined as "biologically pure." A monoculture of a particular strain is, of course, "biologically pure." As used herein, the term "enriched culture" of an isolated microbial strain refers to a microbial culture that contains more that 50%, 60%, 70%, 80%, 90%, or 95% of the isolated strain.

A "plant element" is intended to generically reference either a whole plant or a plant component, including but not limited to plant tissues, parts, and cell types. A plant element is preferably one of the following: whole plant, seedling, meristematic tissue, ground tissue, vascular tissue, dermal tissue, seed, leaf, root, shoot, stem, flower, fruit, stolon, bulb, tuber, corm, kelki, shoot, bud. As used herein, a "plant element" is synonymous to a "portion" of a plant, and refers to any part of the plant, and can include distinct tissues and/or organs, and may be used interchangeably with the term "tissue" throughout.

Similarly, a "plant reproductive element" is intended to generically reference any part of a plant that is able to initiate other plants via either sexual or asexual reproduction of that plant, for example but not limited to: seed, seedling, root, shoot, stolon, bulb, tuber, corm, keiki, or bud.

"Agricultural plants", or "plants of agronomic importance", include plants that are cultivated by humans for food, feed, fiber, and fuel purposes. Agricultural plants include monocotyledonous species such as: maize (*Zea mays*), common wheat (*Triticum aestivum*), spelt (*Triticum spelta*), einkorn wheat (*Triticum monococcum*), emmer wheat (*Triticum dicoccum*), durum wheat (*Triticum durum*), Asian rice (*Oryza sativa*), African rice (*Oryza* glabaerreima), wild rice (*Zizania aquatica, Zizania latifolia, Zizania palustris, Zizania texana*), barley (*Hordeum vulgare*), Sorghum (*Sorghum bicolor*), Finger millet (*Eleusine coracana*), Proso millet (*Panicum miliaceum*), Pearl millet (*Pennisetum glaucum*), Foxtail millet (*Setaria italica*), Oat (*Avena sativa*), Triticale (*Triticosecale*), rye (*Secale* cereal), Russian wild rye (*Psathyrostachys juncea*), bamboo (Bambuseae), or sugarcane (e.g., *Saccharum arundinaceum, Saccharum barberi, Saccharum bengalense, Saccharum edule, Saccharum munja, Saccharum officinarum, Saccharum procerum, Saccharum ravennae, Saccharum robustum, Saccharum sinense*, or *Saccharum spontaneum*); as well as dicotyledonous species such as: soybean (*Glycine max*), canola and rapeseed cultivars (*Brassica napus*), cotton (genus *Gossypium*), alfalfa (*Medicago sativa*), cassava (genus *Manihot*), potato (*Solanum tuberosum*), tomato (*Solanum lycopersicum*), pea (*Pisum sativum*), chick pea (*Cicer arietinum*), lentil (*Lens culinaris*), flax (*Linum usitatissimum*) and many varieties of vegetables.

A "host plant" includes any plant, particularly a plant of agronomic importance, which can live without disease while an endophyte lives on or within the plant or plant element or on or in a medium in close physical proximity with the plant or plant element. For example, a host plant can live without disease while an endophyte colonizes its apoplastic fluid. In an additional example, a host plant can live without disease while an endophyte lives in its rhizosphere.

A "host fungus" includes any fungus which can live without disease while an endophyte lives within the fungus. In some embodiments, the host fungus confers an agronomic benefit in agricultural plants. In some embodiments, the host fungus facilitates the stability, vigor, storage, and/or application of the endophyte composition As used herein, a microbe is said to "colonize" a plant or plant element or fungus when it can exist as an endophyte in relationship with said plant or plant element or fungus. In some embodiments, an endophyte is said to "colonize" a plant or plant element when it can be stably detected within the plant or plant element over a period time, such as one or more days, weeks, months or years. Some of the compositions and methods described herein involve plurality of endophytes in an amount effective to colonize a plant or plant element or fungus.

A "non-host target" means an organism or chemical compound that is altered in some way after contacting a host plant or host fungus that comprises an endophyte, as a result of a property conferred to the host plant or host fungus by the endophyte.

As used herein, a "hybrid plant" refers generally refers to a plant that is the product of a cross between two genetically or epigenetically different parental plants. A hybrid plant is generated by either a natural or artificial process of hybridization whereby the entire genome of one species, variety cultivar, breeding line or individual plant is combined intra- or interspecifically into the genome of species, variety or cultivar or line, breeding line or individual plant by crossing.

An "inbred plant", as used herein, refers to a plant or plant line that has been repeatedly crossed or inbred to achieve a high degree of genetic and epigenetic uniformity, and low heterozygosity, as is known in the art.

The term "isoline" is a comparative term, relating to comparisons made among one or more groups of organisms that are substantially epigenetically and genetically identical and are grown in conditions which differ only in an experimental condition or treatment. As a non-limiting example, the condition of interest may be heterologous disposition of an endophyte on a plant or application of a synthetic combination comprising a treatment formulation and a plurality of endophytes. In another example, two similarly situated and substantially genetically and epigenetically identical seeds may be treated with a formulation, one that introduces an endophyte composition and one that does not. Any phenotypic differences between the plants derived from those seeds when grown or stored in identical conditions may be attributed to the endophyte treatment, thus forming an isoline comparison. In some embodiments, an isoline comparison is made between groups of organisms wherein each group includes at least 5 organisms, between 5 and 10 organisms, at least 10 organisms, between 10 and 100 organisms, for example, at least 100 organisms, between 100 and 300 organisms, at least 300 organisms, between 300 and 1,000 organisms, at least 1,000 organisms, between 1,000 and 3,000 organisms, at least 3,000 organisms, between 3,000 and 10,000 organisms, at least 10,000 organisms, between 10,000 and 30,000 organisms, at least 30,000 organisms, between 30,000 and 100,000 organisms, at least 100,000 organisms or more. In some embodiments, the organisms of the isoline comparison are plants or plant elements.

Similarly, by the terms "reference plant", "reference agricultural plant" or "reference seed", it is meant a similarly situated agricultural plant or seed of the same species, strain, or cultivar to which a treatment, formulation, composition or endophyte preparation as described herein is not administered/contacted. A reference agricultural plant or seed, therefore, is identical to the treated plant with the exception of the presence of the endophyte and can serve as a control for detecting the effects of the endophyte that is conferred to the plant. In some embodiments, the reference plant is an isoline plant and is referred to as a "reference isoline plant".

A "reference environment" refers to the environment, treatment or condition of the plant in which a measurement is made. For example, production of a compound in a plant associated with an endophyte can be measured in a reference environment of drought stress, and compared with the levels of the compound in a reference agricultural plant under the same conditions of drought stress. Alternatively, the levels of a compound in plant associated with an endophyte and reference agricultural plant can be measured under identical conditions of no stress.

A "population" of plants refers to more than one plant, that are of the same taxonomic category, typically of the same species, and will also typically share a common genetic derivation.

In some cases, the present invention contemplates the use of microbes that are "compatible" with agricultural chemicals, including but not limited to, a fungicide, an anticomplex compound, a bactericide, a virucide, an herbicide, a nematicide, a parasiticide, a pesticide, or any other agent widely used in agricultural which has the effect of killing or otherwise interfering with optimal growth of another organism. As used herein, a microbe is "compatible" with an agricultural chemical, when the microbe is modified, such as by genetic modification, e.g., contains a transgene that confers resistance to an herbicide, or otherwise adapted to grow in, or otherwise survive, the concentration of the agricultural chemical as used in agriculture. For example, a microbe disposed on the surface of plant element is compatible with the fungicide metalaxyl if it is able to survive the concentration as used in agriculture.

"Biomass" means the total mass or weight (fresh or dry), at a given time, of a plant tissue, plant tissues, an entire plant, or population of plants, usually given as weight per unit area. The term may also refer to all the plants or species in the community (community biomass).

The compositions and methods herein may provide for an improved "agronomic trait" or "trait of agronomic importance" to a host plant, which include, but are not limited to germination rate, disease resistance, heat tolerance, drought tolerance, water use efficiency, cold tolerance, salinity tolerance, metal tolerance, herbicide tolerance, chemical tolerance, nitrogen utilization, nutrient utilization, resistance to nitrogen stress, nitrogen fixation, pathogen resistance, insect resistance, yield, yield under water-limited conditions, grain weight, fruit weight, kernel moisture content, number of ears, number of kernels per ear, health enhancement, vigor, growth, photosynthetic capability, nutrition enhancement, altered protein content, altered oil content, biomass, root biomass, root length, root surface area, root architecture, shoot length, shoot height, shoot biomass, seed weight, seed carbohydrate composition, seed oil composition, number of pods, delayed senescence, stay-green, seed protein composition, dry weight of mature seeds, fresh weight of mature seeds, number of mature seeds per plant, number of flowers per plant, chlorophyll content, rate of photosynthesis, number of leaves, number of pods per plant, length of pods per plant, number of wilted leaves per plant, number of severely wilted leaves per plant, number of non-wilted leaves per plant, resistance to a fungal pathogen, resistance to a bacterial pathogen, resistance to a viral pathogen, resistance to a nematode, a detectable modulation in the level of a metabolite, a detectable modulation in gene expression, and a detectable modulation in the proteome, and combinations thereof.

Additionally, "altered metabolic function" or "altered enzymatic function" may include, but not be limited to, the following: altered production of an auxin, altered nitrogen fixation, altered production of an antimicrobial compound, altered production of a siderophore, altered mineral phosphate solubilization, altered production of a cellulase, altered production of a chitinase, altered production of a xylanase, altered production of acetoin and altered ability to metabolize a carbon source.

An "increased yield" can refer to any increase in biomass or seed or fruit weight, seed size, seed number per plant, seed number per unit area, bushels per acre, tons per acre, kilo per hectare, carbohydrate per measure of seed, oil per measure of seed, or protein per measure of seed. Typically, the particular characteristic is designated when referring to increased yield, e.g., increased grain yield or increased oil yield.

"Agronomic trait potential" is intended to mean a capability of a plant element for exhibiting a phenotype at some point during its life cycle, or conveying said phenotype to another plant element with which it is associated in the same plant. For example, a plant element may comprise an endophyte that will provide benefit to leaf tissue of a plant from which the plant element is grown; in such case, the plant element comprising such endophyte has the agronomic trait potential for a particular phenotype (for example, increased biomass in the plant) even if the seed itself does not display said phenotype.

By the term "capable of metabolizing" a particular carbon substrate, it is meant that the microbe is able to utilize that carbon substrate. In some embodiments, a microbe capable of metabolizing a particular carbon substrate is able to utilize that carbon substrate as a sole energy source.

A "treatment formulation" refers to a mixture of chemicals that facilitate the stability, vigor, storage, and/or application of endophyte composition(s). In some embodiments, treatment formulations may comprise any one or more agents such as: surfactant, a buffer, a tackifier, a microbial stabilizer, a fungicide, an anticomplex agent, an herbicide, a nematicide, an insecticide, a plant growth regulator, a rodenticide, a desiccant, a nutrient, an excipient, a wetting agent, a salt, and combinations thereof. In some embodiments, an agriculturally compatible carrier can be used to formulate a treatment formulation or other composition that includes one or more purified endophytes.

Some compositions described herein contemplate the use of an agriculturally compatible carrier. As used herein an "agriculturally compatible carrier" refers to any material, other than water, that can be added to a plant element (e.g., a seed or a seedling) without causing/having an adverse effect on the plant element (e.g., reducing seed germination), or the plant that grows from the plant element, or the like.

As used herein, a nucleic acid has "homology" or is "homologous" to a second nucleic acid if the nucleic acid sequence has a similar sequence to the second nucleic acid sequence. The terms "identity", "percent sequence identity" or "identical" in the context of nucleic acid sequences refer to the residues in the two sequences that are the same when aligned for maximum correspondence. There are a number of different algorithms known in the art that can be used to measure nucleotide sequence identity. Nucleotide sequence identity can be measured by a local or global alignment, preferably implementing an optimal local or optimal global alignment algorithm. For example, a global alignment may be generated using an implementation of the Needleman-Wunsch algorithm (Needleman, S. B. & Wunsch, C. D. (1970) Journal of Molecular Biology. 48(3):443-53). For example, a local alignment may be generated using an implementation of the Smith-Waterman algorithm (Smith T. F & Waterman, M. S. (1981) Journal of Molecular Biology. 147(1):195-197). Optimal global alignments using the Needleman-Wunsch algorithm and optimal local alignments using the Smith-Waterman algorithm are implemented in USEARCH, for example USEARCH version v8.1.1756_i86osx32. In some embodiments the nucleic acid sequence to be aligned is a complete gene. In some embodiments, the nucleic acid sequence to be aligned is a gene fragment. In some embodiments, the nucleic acid sequence to be aligned is an intergenic sequence. In a preferred embodiment, inference of homology from a sequence alignment is make where the region of alignment is at least 85% of the length of the query sequence.

The term "substantial homology" or "substantial similarity," when referring to a nucleic acid or fragment thereof, indicates that, when optimally aligned with appropriate nucleotide insertions or deletions with another nucleic acid (or its complementary strand), there is nucleotide sequence identity in at least about 76%, 80%, 85%, or at least about 90%, or at least about 95%, 96%, 97%, 98% or 99% of the positions of the aligment, wherein the region of alignment is at least about 85%, or at least about 90%, or at least about 95%, 96%, 97%, 98%, 99% or 100% of the length of the query sequence.

As used herein, the terms "operational taxonomic unit", "OTU", "taxon", "hierarchical cluster", and "cluster" in the context of nucleic acid sequences are used interchangeably. An operational taxonomic unit (OTU) refers to a group of one or more organisms that comprises a node in a clustering tree. Preferably, clusters are generated by sequence identity wherein sequences within a cluster share at least about 95%, 96%, 97%, 98% or 99% sequence identity. Preferably the sequence is a nucleic acid sequence is a 16S sequence, an ITS sequence, a functionally conserved gene or portion thereof. In some embodiments, an OTU is a group tentatively assumed to be a valid taxon for purposes of phylogenetic analysis. In other embodiments, an OTU is any of the extant taxonomic units under study. In yet another embodiment, an OTU is given a name and a rank. For example, an OTU can represent a domain, a sub-domain, a kingdom, a sub-kingdom, a phylum, a sub-phylum, a class, a sub-class, an order, a sub-order, a family, a subfamily, a genus, a subgenus, or a species. In some embodiments, OTUs can represent one or more organisms from the kingdoms eubacteria, protista, or fungi at any level of a hierarchal order. In some embodiments, an OTU represents a prokaryotic or fungal order.

"Internal Transcribed Spacer" (ITS) refers to the spacer DNA (non-coding DNA) situated between the small-subunit ribosomal RNA (rRNA) and large-subunit (LSU) rRNA genes in the chromosome or the corresponding transcribed region in the polycistronic rRNA precursor transcript. ITS gene sequencing is a well-established method for studying phylogeny and taxonomy of fungi. In some cases, the "Large SubUnit" (LSU) sequence is used to identify fungi. LSU gene sequencing is a well-established method for studying phylogeny and taxonomy of fungi. Some fungal endophytes of the present invention may be described by an ITS sequence and some may be described by an LSU sequence. Both are understood to be equally descriptive and accurate for determining taxonomy.

As used herein, the terms "water-limited condition", "water stress condition" and "drought condition", or "water-limited", "water stress", and "drought", may be used interchangeably. For example, a method or composition for improving a plant's ability to grow under drought conditions means the same as the ability to grow under water-limited conditions. In such cases, the plant can be further said to display improved tolerance to drought stress. High molecular weight polyethylene glycol (PEG) can be used to create highly controlled, water limited experimental conditions that decrease the water potential similarly to drying soils. (Sakthivelu, G. et al. General and Applied Plant Physiology Drought-induced alterations in soybean cultivars. Physiology, 2008, Special Issue, 34 (1-2), 103-112).

The terms "decreased", "fewer", "slower" and "increased", "faster", "enhanced", "greater" as used herein refers to a decrease or increase in a characteristic of the endophyte treated seed or resulting plant compared to an untreated seed or resulting plant. For example, a decrease in a characteristic may be at least 1%, at least 2%, at least 3%, at least 4%, at least 5%, at least 10%, at least 15%, at least 20%, at least 25%, at least 30%, at least 35%, at least 40%, at least 45%, at least 50%, at least about 60%, at least 75%, at least about 80%, at least about 90%, at least 100%, at least 200%, at least about 300%, at least about 400% or more lower than the untreated control. For example, a decrease may be between 1% and 5%, or between 5% and 10%, or between 10% and 15%, or between 15% and 20%, or between 20% and 25%, or between 25% and 30%, or between 30% and 35%, or between 35% and 40%, or between 45% and 50% lower than the untreated control or the formulation control. An increase may be at least 1%, at least 2%, at least 3%, at least 4%, at least 5%, at least 10%, at least 15%, at least 20%, at least 25%, at least 30%, at least 35%, at least 40%, at least 45%, at least 50%, at least about 60%, at least 75%, at least about 80%, at least about 90%, at least 100%, at least 200%, at least about 300%, at least about 400% or more higher than the untreated control. For example, an increase may be between 1% and 5%, or between 5% and 10%, or between 10% and 15%, or between 15% and 20%, or between 20% and 25%, or between 25% and 30%, or between 30% and 35%, or between 35% and 40%, or between 45% and 50% higher than the untreated control or the formulation control.

As used herein, "compatibility" in the context of two or more endophyte populations refers to endophyte populations that do not significantly interfere with the growth, propagation, and/or production of beneficial substances of the other one or more beneficial endophyte populations.

As used herein, a fungicide is any compound or agent (whether chemical or biological) that can either inhibit the growth of a fungus or kill a fungus. In that sense, a "fungicide", as used herein, encompasses compounds that may be fungistatic or fungicidal.

DETAILED DESCRIPTION

The present invention is directed to methods and synthetic combinations, including compositions of endophytes, plant-endophyte combinations, treatment formulation-endophyte combinations, and plant-treatment formulation-endophyte combinations, that confer an agronomic benefit in agricultural plants.

In part, the present invention describes preparations of a plurality of endophytes, and the creation of synthetic combinations of agricultural plant elements with formulations comprising a plurality of endophytes. Such beneficial properties include metabolism, transcript expression, proteome alterations, morphology, and the resilience to a variety of environmental stresses, and the combination of a plurality of such properties.

The inventors herein have conceived that a plurality of endophytes can confer significant advantages to agricultural crops, spanning growth under normal and stressed conditions, alter expression of key plant hormones, alter expression of key transcripts in the plant, and other desirable features. Provided and described herein are novel compositions and methods that provide reliable increases in crop yield, biomass, germination, vigor, stress resilience, and other properties to agricultural crops.

As described herein, a plurality of endophytes can be heterologously disposed onto seedlings of a distinct cultivar, species, or crop type and confer benefits to those new recipients. For example, a plurality of endophytes from corn cultivars are heterologously provided to wheat cultivars to confer a benefit.

Combinations of Endophytes and Plant Elements

In some embodiments, the present invention provides synthetic combinations of plant elements with a plurality of endophytes. The synthetic combination can comprise a plant element of any of the plants described herein. In some embodiments, the plant element is surface-sterilized prior to combining with the plurality of endophytes. In some embodiments, the plurality of endophytes can comprise a plurality of purified endophytes, for example, 2, 3, 4 or more different types of endophytes.

In some embodiments, the synthetic combination additionally comprises a seed coating composition, a root treatment, or a foliar application composition. In some embodiments, the seed coating composition, or the root treatment, or the foliar application composition comprises an agent selected from the group consisting of: a fungicide, an antibacterial agent, an herbicide, a nematicide, an insecticide, a plant growth regulator, a rodenticide and a nutrient, and combinations thereof. In some embodiments, the seed coating composition, or the root treatment, or the foliar application composition further comprises an agent selected from the group consisting of an agriculturally acceptable carrier, a tackifier, a microbial stabilizer, a fungicide, an antibacterial agent, an herbicide, a nematicide, an insecticide, a plant growth regulator, a rodenticide, a nutrient, and combinations thereof. In still another embodiment, the root treatment application composition can further contain a rhizobial bacterial preparation. In some embodiments, the plurality of endophytes are prepared in a single preparation that is coated onto the seed. In some embodiments, the plurality of endophytes are heterologously disposed on an exterior surface of or within the plant in an amount effective to colonize the plant.

The present invention contemplates the use of endophytes that are unmodified, as well as those that are modified. In some embodiments, the endophyte is a recombinant endophyte. In some embodiments, the endophyte is modified prior to coating onto the surface of the plant element such that it has enhanced compatibility with an antimicrobial agent when compared with the unmodified. For example, the endophyte can be modified such that it has enhanced compatibility with an antibacterial agent. In an alternative embodiment, the endophyte has enhanced compatibility with an antifungal agent. The endophyte can be modified such that it exhibits at least 3 fold greater, for example, at least 5 fold greater, at least 10 fold greater, at least 20 fold greater, at least 30 fold greater or more resistance to an antimicrobial agent when compared with the unmodified endophyte.

Sources of Endophytes

As described herein, endophytes can be derived from heterologous, homologous, or engineered sources, optionally cultured, administered heterologously as a plurality of endophytes to plant elements, and, as a result of the administration, confer multiple beneficial properties. In some embodiments, endophytes are derived from plant elements or soil. In some embodiments, the plant element from which the endophyte is derived is a monocotyledonous plant. In a particular embodiment, the plant is a cereal plant or tissue thereof. In yet another embodiment, plant is selected from the group consisting of a maize plant, a barley plant, a wheat plant, a sorghum plant, a sugarcane plant, or a rice plant. In some embodiments, the plant element is a naked grain (i.e., without hulls or fruit cases). In an alternative embodiment, the plant element from which the endophyte is derived is a dicotyledonous plant. For example, plant can be selected from the group consisting of a cotton plant, a rapeseed plant, a canola plant, a tomato plant, a pepper plant, or a soybean plant.

In some embodiments, the endophytes can be obtained from a plant element of the same or different crop, and can be from the same or different cultivar or variety as the plant element to which the composition is heterologously disposed. In some cases, plants are inoculated with endophytes that are exogenous to the plant element of the inoculated plant. In some embodiments, the endophyte is derived from a plant of another species. For example, a plurality of endophytes that are normally found in dicots are heterologously disposed into a monocot plant (e.g., inoculating corn with a soybean-derived endophytes), or vice versa. For example, endophytes from a particular corn variety can be isolated from the rhizosphere and heterologously disposed onto the surface of a corn seed of the same variety. In other embodiments, the endophytes can be isolated from a related species. For example, an endophyte isolated from *Triticum monococcum* (einkorn wheat) can be heterologously disposed onto the surface of a *T. aestivum* (common wheat) plant element. In some embodiments, an endophyte from *Hordeum vulgare* (barley) can be isolated and heterologously disposed into a plant element of another member of the Triticeae family, for example, plant elements of the rye plant, *Secale cereale*. In still another embodiment, the endophytes can be isolated from a plant part of a plant that is distantly related to the plant into which the endophyte is to be heterologously disposed. In some embodiments, the distantly related plant may be an agricultural plant. For example, endophytes derived from tomato fruit are isolated and heterologously disposed into a rice leaf tissue. In some embodiments, the distantly related plant may be a wild or non-agricultural plant. For example, endophytes normally associated with tubers of the wild potato *Solanum vernei* can be heterologously disposed onto commercial varieties of *Gossypium hirsutum* plants.

In yet another embodiment, endophytes used in a composition or used to make a synthetic combination can be obtained from different individual plants of the same variety, or of a related plant, each of which has been subjected to different growth conditions. For example, an endophyte derived from a drought-affected plant of one variety can be isolated and heterologously disposed onto the plant element that was derived from a plant of the same variety not subjected to drought. In such cases, the endophyte is considered to be heterologously associated with the plant element onto which it is applied.

In some embodiments, the endophyte is derived from a plant of another species. For example, a plurality of endophytes that are normally found in dicots are heterologously disposed into a monocot plant (e.g., inoculating corn with a soybean-derived endophytes), or vice versa. In other cases, the endophyte to be inoculated onto a plant can be derived from a related species of the plant that is being inoculated. In some embodiments, the endophyte can be derived from a related taxon, for example, from a related species. The plant of another species can be an agricultural plant. For example, an endophyte derived from *Hordeum irregulare* can be used to inoculate a *Hordeum vulgare* L., plant. Alternatively, it can be derived from a 'wild' plant (i.e., a non-agricultural plant). For example, endophytes normally associated with the wild cotton *Gossypium klotzschianum* can be used to inoculate commercial varieties of *Gossypium hirsutum* plants. As an alternative example of deriving an endophyte from a 'wild' plant, endophytic bacteria isolated from the South East Asian jungle orchid, *Cymbidium eburneum*, can be isolated and testing for their capacity to benefit seedling development and survival of agricultural crops such as wheat, maize, soy and others. In other cases, the endophyte can be isolated from an ancestral species of the inoculated plant. For example, an endophyte derived from *Zea diploperennis* can be used to inoculate a commercial variety of modern corn, or *Zea mays*.

Compositions described herein comprise a plurality of at least two endophytes. In some embodiments, the plurality includes at least 3, at least 4, at least 5, at least 6, at least 7, at least 8, at least 9, at least 10, at least 15, at least 20, at least 25, or more (e.g., 3, 4, 5, 6, 7, 8, 9, 10, 15, 20, 25 or greater than 25) different endophytes. In some embodiments, the endophytes are obtained from the same plant element, the same plant, the same species of plants, the same genus of plants, or the same families of plants. In other embodiments, the endophytes are obtained from different families of plants, or different genera of plant or fungus, from the same genera but different species of plants, or from different plant parts. The different endophytes can be obtained from the same cultivar of agricultural plant (e.g., the same maize, wheat, rice, or barley plant), different cultivars of the same agricultural plant (e.g., two or more cultivars of maize, two or more cultivars of wheat, two or more cultivars of soybean, two or more cultivars of rice, or two or more cultivars of barley), or different species of the same type of agricultural plant (e.g., two or more different species of maize, two or more different species of wheat, two or more different species of soybean, two or more different species of rice, or two or more different species of barley). In embodiments in which two or more endophytes are used, each of the endophytes can have different properties or activities, e.g., produce different metabolites, produce different enzymes such as different hydrolytic enzymes, confer different beneficial traits, or colonize different elements of a plant (e.g., leaves, stems, flowers, fruits, seeds, or roots). For example, one endophyte can colonize a first and a second endophyte can colonize a tissue that differs from the first tissue. In some embodiments, the first and second endophyte are both bacteria. In some embodiments, the the first and second endophytes are both fungus. In some embodiments, the first and second endophyte are each a fungus and a bacterium.

In some embodiments, at least two, at least three, at least four, at least five, at least six, at least seven, at least eight, at least night, or at least ten or more endophytes of an endophytic combination are selected from any of the families listed in Table 17. In some embodiments, the endophytes belong to any of the following families: Acetobacteraceae, Acidobacteriaceae, Acidothermaceae, Aerococcaceae, Alcaligenaceae, Alicyclobacillaceae, Alteromonadaceae, Anaerolineaceae, Aurantimonadaceae, Bacillaceae, Bacteriovoracaceae, Bdellovibrionaceae, Bradyrhizobiaceae, Brevibacteriaceae, Brucellaceae, Burkholderiaceae, Carboxydocellaceae, Caulobacteraceae, Cellulomonadaceae, Chitinophagaceae, Chromatiaceae, Chthoniobacteraceae, Chthonomonadaceae, Clostridiaceae, Comamonadaceae, Corynebacteriaceae, Coxiellaceae, Cryomorphaceae, Cyclobacteriaceae, Cytophagaceae, Deinococcaceae, Dermabacteraceae, Dermacoccaceae, Enterobacteriaceae, Enterococcaceae, Erythrobacteraceae, Fibrobacteraceae, Flammeovirgaceae, Flavobacteriaceae, Frankiaceae, Fusobacteriaceae, Gaiellaceae, Gemmatimonadaceae, Geodermatophilaceae, Glycomycetaceae, Haliangiaceae, Halomonadaceae, Holosporaceae, Hyphomicrobiaceae, Iamiaceae, Intrasporangiaceae, Kineosporiaceae, Koribacteraceae, Lachnospiraceae, Lactobacillaceae, Legionellaceae, Leptospiraceae, Leuconostocaceae, Methylobacteriaceae, Methylocystaceae, Methylophilaceae, Microbacteriaceae, Micrococcaceae, Micromonosporaceae, Moraxellaceae, Mycobacteriaceae, Mycoplasmataceae, Myxococcaceae, Nakamurellaceae, Neisseriaceae, Nitrosomonadaceae, Nocardiaceae, Nocardioidaceae, Oceanospirillaceae, Opitutaceae, Oxalobacteraceae, Paenibacillaceae, Parachlamydiaceae, Pasteurellaceae, Patulibacteraceae, Peptostreptococcaceae, Phyllobacteriaceae, Piscirickettsiaceae, Planctomycetaceae, Planococcaceae, Polyangiaceae, Porphyromonadaceae, Prevotellaceae, Promicromonosporaceae, Pseudomonadaceae, Pseudonocardiaceae, Rhizobiaceae, Rhodobacteraceae, Rhodospirillaceae, Roseiflexaceae, Rubrobacteriaceae, Sandaracinaceae, Sanguibacteraceae, Saprospiraceae, Segniliparaceae, Shewanellaceae, Sinobacteraceae, Solibacteraceae, Solimonadaceae, Solirubrobacteraceae, Sphingobacteriaceae, Sphingomonadaceae, Spiroplasmataceae, Sporichthyaceae, Sporolactobacillaceae, Staphylococcaceae, Streptococcaceae, Streptomycetaceae, Syntrophobacteraceae, Veillonellaceae, Verrucomicrobiaceae, Weeksellaceae, Xanthobacteraceae, Xanthomonadaceae, Aspergillaceae, Ceratobasidiaceae, Coniochaetaceae, Cordycipitaceae, Corticiaceae, Cystofilobasidiaceae, Davidiellaceae, Debaryomycetaceae, Dothioraceae, Erysiphaceae, Filobasidiaceae, Glomerellaceae, Hydnaceae, Hypocreaceae, Leptosphaeriaceae, Montagnulaceae, Mortierellaceae, Mycosphaerellaceae, Nectriaceae, Orbiliaceae, Phaeosphaeriaceae, Pleosporaceae, Pseudeurotiaceae, Rhizopodaceae, Sclerotiniaceae, Stereaceae, and Trichocomaceae.

In some embodiments, at least two, at least three, at least four, at least five, at least six, at least seven, at least eight, at least night, or at least ten or more endophytes of an endophytic combination belong to any of the orders listed in Table 17. In some embodiments, the endophytes belong to any of the following orders: Acidimicrobiales, Acidobacteriales, Actinomycetales, Alteromonadales, Anaerolineales, Bacillales, Bacteroidales, Bdellovibrionales, Burkholderiales, Cantharellales, Capnodiales, Caulobacterales, Chlamydiales, Chloroflexales, Chromatiales, Chthoniobacterales, Chthonomonadales, Clostridiales, Coniochaetales, Corticiales, Corynebacteriales, Cystofilobasidiales, Cytophagales, Deinococcales, Des ulfuromonadales, Diaporthales, Dothideales, Enterobacteriales, Entomoplasmatales, Erysiphales, Erythrobasidiales, Eurotiales, Fibrobacterales, Filobasidiales, Flavobacteriales, Frankiales, Fusobacteriales, Gaiellales, Gemmatimonadales, Glycomycetales, Helotiales, Hymenochaetales, Hypocreales, Incertae sedis, JG30-KF-CM45, Kineosporiales, Lactobacillales, Legionellales, Methylophilales, Micrococcales, Micromonosporales, Mollicutes Incertae Sedis, Mortierellales, Mucorales, Mycoplasmatales, Myxococcales, Neisseriales, Nitrosomonadales, Obscuribacterales, Oceanospirillales, Opitutales, Orbiliales, Pasteurellales, Pedosphaerales, Planctomycetales, Pleosporales, Propionibacteriales, Pseudomonadales, Pseudonocardiales, Rhizobiales, Rhodobacterales, Rhodospirillales, Rickettsiales, Rubrobacterales, Russulales, Saccharomycetales, Saprospirales, Selenomonadales, Solibacterales, Solirubrobacterales, Sphingobacteriales, Sphingomonadales, Spirobacillales, Spirochaetales, Sporidiobolales, Streptomycetales, Syntrophobacterales, Thermoanaerobacterales, Thiotrichales, Tremellales, Verrucomicrobiales, and Xanthomonadales.

In some embodiments, at least two, at least three, at least four, at least five, at least six, at least seven, at least eight, at least night, or at least ten or more endophytes of an endophytic combination belong to any of the classes listed in Table 17. In some embodiments, the endophytes belong to any of the following classes: Acidimicrobiia, Acidobacteria, Actinobacteria, Agaricomycetes, Alphaproteobacteria, Anaerolineae, Bacilli, Bacteroidia, Betaproteobacteria, Chlamydiia, Chloroflexia, Chthonomonadetes, Clostridia, Cyanobacteria, Cystobasidiomycetes, Cytophagia, Deinococci, Deltaproteobacteria, Dothideomycetes, Eurotiomycetes, Fibrobacteria, Flavobacteriia, Fusobacteriia, Gammaproteobacteria, Gemmatimonadetes, Holophagae, Leotiomycetes, Melainabacteria, Microbotryomycetes, Mollicutes, Negativicutes, Opitutae, Orbiliomycetes, Pedosphaerae, Phycisphaerae, Planctomycetacia, Planctomycetia, Rubrobacteria, Saccharomycetes, Saprospirae, Solibacteres, Sordariomycetes, Spartobacteria, Sphingobacteriia, Spirochaetes, Thermoleophilia, Thermomicrobia, Tremellomycetes, and Verrucomicrobiae.

In some embodiments, the plurality of endophytes comprises at least two, at least three, at least four, at least five, or greater than five, endophytes, each comprising a 16S or ITS nucleic acid sequence selected from the group consisting of SEQ ID NO: 1-1703.

In some embodiments, the plurality of endophytes comprises at least two, at least three, at least four, at least five, or greater than five, endophytes, each comprising a 16S or ITS nucleic acid sequence at least 80%, at least 85%, at least 90%, at least 92%, at least 93%, at least 94%, at least 95%, at least 96%, at least 97%, at least 98%, at least 99%, or 100% identical from a sequence selected from the group consisting of SEQ ID NO: 1-1703.

In some embodiments, the plurality of endophytes comprises two endophytes, where the pairs of endophytes are chosen from any of the pairs in Tables 10-16, and the endophytes comprise a 16S or ITS nucleic acid sequence that is at least 90% identical, for example, at least 91% identical, at least 92% identical, at least 93% identical, at least 94% identical, at least 95% identical, at least 96% identical, at least 97% identical, at least 98% identical, at least 99% identical, at least 99.5% identical or 100% identical to SEQ ID NO: 1-1703.

In some embodiments, an endophyte is capable of metabolizing D-alanine, D-aspartic acid, D-serine, D-threonine, glycyl-L-aspartic acid, glycyl-L-glutamic acid, glycyl-L-proline, glyoxylic acid, inosine, L-alanine, L-alanyl-glycine, L-arabinose, L-asparagine, L-aspartic acid, L-glutamic acid, L-glutamine, L-proline, L-serine, L-threonine, tyramine, uridine, proline, arabinose, xylose, mannose, sucrose, maltose, D-glucosamine, trehalose, oxalic acid, or salicin as a sole carbon source. In some embodiments, the endophyte comprises a nucleic acid sequence within its genome that encodes a protein allowing it to metabolize arabinose.

Relocalization of Endophytes. In some embodiments, a plurality of endophytes that are used to treat a plant element localize to a different tissue of the plant, regardless of the original source of the endophyte. In some embodiments, the endophyte is capable of localizing to any one of the tissues in the plant, including but not limited to the root, adventitious root, seminal root, root hair, shoot, leaf, flower, bud, tassel, meristem, pollen, pistil, ovaries, stamen, fruit, stolon, rhizome, nodule, tuber, trichome, guard cells, hydathode, petal, sepal, glume, rachis, vascular cambium, phloem, xylem, and combinations thereof. In some embodiments, the endophyte is capable of localizing to the root and/or the root hair of the plant. In some embodiments, the endophyte is capable of localizing to the photosynthetic tissues, for example, leaves and shoots of the plant. In some embodiments, the endophyte is localized to the vascular tissues of the plant, for example, in the xylem and phloem. In some embodiments, the endophyte is capable of localizing to the reproductive tissues (e.g., flower, pollen, pistil, ovaries, stamen, fruit) of the plant. In some embodiments, the endophyte is capable of localizing to the root, shoots, leaves and reproductive tissues of the plant. In some embodiments, the endophyte colonizes a fruit or seed tissue of the plant. In some embodiments, the endophyte is able to colonize the plant such that it is present in the surface of the plant (i.e., its presence is detectably present on the plant exterior, or the episphere of the plant). In some embodiments, the endophyte is capable of localizing to substantially all, or all, tissues of the plant. In certain embodiments, the endophyte is not localized to the root of a plant. In some embodiments, the endophyte is not localized to the photosynthetic tissues of the plant.

Functional Attributes of Endophytes

In some embodiments, a plurality of endophytes, or each individual type of endophytes of that plurality, may produce one or more compounds and/or have one or more activities, e.g., one or more of the following: production of a metabolite, production of a phytohormone such as auxin, production of acetoin, production of an antimicrobial compound, production of a siderophore, production of a cellulase, production of a pectinase, production of a chitinase, production of a xylanase, nitrogen fixation, mineral phosphate solubilization, and combinations thereof. For example, an endophyte can produce a phytohormone selected from the group consisting of an auxin, a cytokinin, a gibberellin, ethylene, a brassinosteroid, and abscisic acid. In some embodiments, the endophyte produces auxin (e.g., indole-3-acetic acid (IAA)). Production of auxin can be assayed as described herein. Many of the microbes described herein are capable of producing the plant hormone auxin indole-3-acetic acid (IAA) when grown in culture. Auxin plays a key role in altering the physiology of the plant, including the extent of root growth. In some embodiments, the plurality of endophytes are heterologously disposed on the surface or within a tissue of the plant element in an amount effective to detectably increase production of auxin in the agricultural plant when compared with an isoline reference plant. In some embodiments, increased auxin production can be detected in a tissue type selected from the group consisting of the root, shoot, leaves, and flowers.

In some embodiments, a plurality of endophytes, or each individual type of endophytes of that plurality, produce a compound with antimicrobial properties. For example, the compound can have antibacterial or anti-fungal properties, as determined by the growth assays provided herein. In some embodiments, the compound with antibacterial properties shows bacteriostatic or bactericidal activity against *E. coli* and/or *Bacillus* sp. In other embodiments, the endophyte produces a compound with antifungal properties, for example, fungicidal or fungistatic activity against *S. cerevisiae* and/or *Rhizoctonia*.

In some embodiments, a plurality of endophytes, or each individual type of endophytes of that plurality, is capable of nitrogen fixation, and is thus capable of producing ammonium from atmospheric nitrogen. The ability of endophytes to fix nitrogen is confirmed by testing for growth of the fungus in nitrogen-free growth media, for example, LGI media, as described herein.

In some embodiments, a plurality of endophytes, or each individual type of endophytes of that plurality, produce a compound that increases the solubility of mineral phosphate in the medium, i.e., mineral phosphate solubilization, for example, using growth assays known in the art. In some embodiments, the endophytes produce a compound that allows the bacterium to grow in growth media comprising $Ca_3HPO_4$ as the sole phosphate source.

In some embodiments, a plurality of endophytes, or each individual type of endophytes of that plurality, produce a siderophore. Siderophores are small high-affinity iron chelating agents secreted by microorganisms that increase the bioavailability of iron. Siderophore production by the endophytes can be detected, for example, using methods known in the art.

In some embodiments, a plurality of endophytes, or each individual type of endophytes of that plurality, produce a hydrolytic enzyme. For example, in some embodiments, endophytes produce a hydrolytic enzyme selected from the group consisting of a cellulase, a pectinase, a chitinase and a xylanase. Hydrolytic enzymes can be detected using the methods known in the art.

Selection of Endophytes for Use in a Plurality of Endophytes

In some embodiments, the present invention contemplates methods of manually or mechanically combining a plurality of endophytes with one or more plant elements, such as a seed, a leaf, or a root, in order to confer an improved agronomic trait or improved agronomic trait potential to said plant element or host plant.

A plurality of endophytes can be selected by any one or more of several criteria. In some embodiments, the OTUs of endophytes that co-occur together in plant elements are identified, and endophytes within those OTUs are used as a plurality to provide a benefit to plant elements.

In other embodiments, a plurality of endophytes can be selected on the basis of carbon sources they metabolize. In some aspects, an endophyte may be capable of using any one or more of the following: 1,2-Propanediol, 2-Aminoethanol, 2-Deoxy adenosine, Acetic acid, Acetoacetic acid, Adenosine, Adonitol, Bromo succinic acid, Citric acid, D-Alanine, D-Aspartic acid, D-Cellobiose, D-Fructose, D-Fructose-6-Phosphate, D-Galactonic acid-γ-lactone, D-Galactose, D-Galacturonic acid, D-Gluconic acid, D-Glucosaminic acid, D-Glucose-1-Phosphate, D-Glucose-6-Phosphate, D-Glucuronic acid, D-L-Malic acid, D-L-α-Glycerol phosphate, D-Malic acid, D-Mannitol, D-Mannose, D-Melibiose, D-Psicose, D-Ribose, D-Saccharic acid, D-Serine, D-Sorbitol, D-Threonine, D-Trehalose, Dulcitol, D-Xylose, Formic acid, Fumaric acid, Glucuronamide, Glycerol, Glycolic acid, Glycyl-L-Aspartic acid, Glycyl-L-Glutamic acid, Glycyl-L-Proline, Glyoxylic acid, Inosine, Lactulose, L-Alanine, L-Alanyl-Glycine, L-Arabinose, L-Asparagine, L-Aspartic acid, L-Fucose, L-Galactonic-acid-γ-lactone, L-Glutamic acid, L-glutamine, L-Lactic acid, L-Lyxose, L-Malic acid, L-Proline, L-Rhamnose, L-Serine, L-Threonine, Maltose, Maltotriose, Methyl Pyruvate, m-Hydroxy Phenyl Acetic acid, m-Inositol, Mono Methyl Succinate, m-Tartaric acid, Mucic acid, N-acetyl-β-D-Mannosamine, N-Acetyl-D-Glucosamine, Phenylethyl-amine, p-Hydroxy Phenyl acetic acid, Propionic acid, Pyruvic acid, Succinic acid, Sucrose, Thymidine, Tricarballylic acid, Tween 20, Tween 40, Tween 80, Tyramine, Uridine, α-D-Glucose, α-D-Lactose, α-Hydroxy Butyric acid, α-Hydroxy Glutaric acid-γ-lactone, α-Keto-Butyric acid, α-Keto-Glutaric acid, α-Methyl-D-Galactoside, β-Methyl-D-glucoside. In preferred embodiments, at least one population is capable of metabolizing any one or more of the following: D-Alanine, D-Aspartic acid, D-Serine, D-ThreonineGlycyl-L-Aspartic acid, Glycyl-L-Glutamic acid, Glycyl-L-Proline, Glyoxylic acid, Inosine, L-Alanine, L-Alanyl-Glycine, L-Arabinose, L-Asparagine, L-Aspartic acid, L-Glutamic acid, L-glutamine, L-Proline, L-Serine, L-Threonine, Tyramine, Uridine, Proline, arabinose, xylose, mannose, sucrose, maltose, D-glucosamine, trehalose, oxalic acid, and salicin. In some aspects, an endophyte may be capable of using any one or more of the following: D-Alanine, D-Aspartic acid, D-Serine, D-ThreonineGlycyl-L-Aspartic acid, Glycyl-L-Glutamic acid, Glycyl-L-Proline, Glyoxylic acid, Inosine, L-Alanine, L-Alanyl-Glycine, L-Arabinose, L-Asparagine, L-Aspartic acid, L-Glutamic acid, L-glutamine, L-Proline, L-Serine, L-Threonine, Tyramine, Uridine, Proline, arabinose, xylose, mannose, sucrose, maltose, D-glucosamine, trehalose, oxalic acid, and salicin.

For example, one endophyte may be capable of utilizing oxalic acid and a second endophyte may be capable of using arabinose. For example, at least one endophyte may be capable of metabolizing proline, at least one endophyte may be capable of metabolizing mannose. It is contemplated that the plurality of endophytes can be selected based on complementary metabolic capabilities: for example, one may be capable of utilizing mannose but not sucrose, and a second may be capable of utilizing sucrose but not mannose. In another aspect, it is contemplated that the plurality of endophytes can be selected based on mutual metabolic capabilities: for example, two endophytes that both are able to utilize mannose. In another aspect, it is contemplated that the plurality of endophytes can be selected based on the synergistic effects of carbon source utilization: for example, one endophyte may have the capability of utilizing mannose but not proline but when in combination with a second endophyte may then display the ability to utilize proline. In other words, one endophyte may be able to promote the ability of another endophyte to utilize a particular carbon source. In another aspect, one endophyte may reduce the ability of another endophyte to utilize a particular carbon source. In another aspect of synergism, two endophytes that are themselves each capable of utilizing one type of carbon source, for example, maltose, may enhance each others' abilities to utilize said carbon source at a greater efficiency. It is contemplated that any combination (mutual, complementary, additive, synergistic) of substrate utilization capabilities may be used as criteria of selection of endophytes of the present invention. It is further contemplated that such combinations of carbon substrate sources for endophyte utilization may include at least two, at least three, at least four, at least five, at least six, at least seven, at least eight, at least nine, at least ten, and even greater than ten different carbon sources.

In some embodiments, the plurality of endophytes comprises at least two, at least three, at least four, at least five, or greater than five, endophytes wherein at least one of said endophytes comprises a gene in its genome that encodes a protein selected from the group consisting of: arabinose ABC transporter ATP-binding protein, arabinose ABC transporter permease, arabinose ABC transporter substrate-binding protein, arabinose import ATP-binding protein AraG, arabinose isomerase, arabinose-proton symporter, L-arabinose ABC transporter periplasmic L-arabinose-binding protein, L-arabinose isomerase, L-arabinose transport ATP-binding protein araG, L-arabinose transporter ATP-binding protein, L-arabinose transporter ATP-binding protein (plasmid), L-arabinose transporter permease, L-arabinose transporter permease (plasmid), L-arabinose transporter permease protein, L-arabinose-binding protein, arabinose-proton symporter.

In some embodiments, the plurality of endophytes can be selected using additional criteria. In some embodiments, compatible endophytes are selected. Incompatible endophyte populations can arise, for example, where one of the populations produces or secretes a compound that is toxic or deleterious to the growth of the other population(s). Incompatibility arising from production of deleterious compounds/agents can be detected using methods known in the art, and as described herein elsewhere. Similarly, the distinct populations can compete for limited resources in a way that makes co-existence difficult.

In some aspects of the present invention, it is contemplated that the plurality of endophytes can provide an increased benefit to the host plant, as compared to that conferred by a single endophyte, by virtue of additive effects. For example, one endophyte strain that induces a benefit in the host plant may induce such benefit equally well in a plant that is also colonized with a different endophyte strain that also induces the same benefit in the host plant. The host plant thus exhibits the same total benefit from the plurality of different endophyte strains as the additive benefit to individual plants colonized with each individual endophyte of the plurality. In one example, a plant is colonized with two different endophyte strains: one provides a 1× increase in biomass when associated with the plant, and the other provides a 2× increase in biomass when associated with a different plant. When both endophyte strains are associated with the same plant, that plant would experience a 3× (additive of 1×+2× single effects) increase in auxin biomass. Additive effects are a surprising aspect of the present invention, as non-compatibility of endophytes may result in a cancelation of the beneficial effects of both endophytes.

In some aspects of the present invention, it is contemplated that a plurality of endophytes can provide an increased benefit to the host plant, as compared to that conferred by a single endophyte, by virtue of synergistic effects. For example, one endophyte strain that induces a benefit in the host plant may induce such benefit beyond additive effects in a plant that is also colonized with a different endophyte strain that also induces that benefit in the host plant. The host plant thus exhibits the greater total benefit from the plurality of different endophyte strains than would be expected from the additive benefit of individual plants colonized with each individual endophyte of the plurality. In one example, a plant is colonized with two different endophyte strains: one provides a 1× increase in biomass when associated with a plant, and the other provides a 2× increase in biomass when associated with a different plant. When both endophyte strains are associated with the same plant, that plant would experience a 5× (greater than an additive of 1×+2× single effects) increase in biomass. Synergistic effects are a surprising aspect of the present invention.

In some embodiments, the plurality of endophytes can be selected on the basis of compounds produced by each type of endophyte. For example, the first population is capable of producing siderophores, and another population is capable of producing anti-fungal compounds. In some embodiments, the first population of endophytes is capable of a function selected from the group consisting of auxin production, nitrogen fixation, production of an antimicrobial compound, siderophore production, mineral phosphate solubilization, cellulase production, chitinase production, xylanase production, and acetoin production. In other embodiments, the second population of endophytes is capable of a function selected from the group consisting of auxin production, nitrogen fixation, production of an antimicrobial compound, siderophore production, mineral phosphate solubilization, cellulase production, chitinase production, xylanase production, and acetoin production. In still another embodiment, the first and second populations are capable of at least one different function.

In some embodiments, the plurality of endophytes can be selected for their distinct localization in the plant after colonization. For example, the first population of endophytes can colonize, and in some cases preferentially colonize, the root tissue, while a second population can be selected on the basis of its preferential colonization of the aerial parts of the agricultural plant. Therefore, in some embodiments, the first population is capable of colonizing one or more of the tissues selected from the group consisting of a root, shoot, leaf, flower, and seed. In other embodiments, the second population is capable of colonizing one or more tissues selected from the group consisting of root, shoot, leaf, flower, and seed. In still another embodiment, the first and second populations are capable of colonizing a different tissue within the agricultural plant.

In still another embodiment, the plurality of endophytes can be selected for their ability to confer one or more distinct agronomic traits on the inoculated agricultural plant, either individually or in association with other endophytes. Where a plurality of endophytes is heterologously disposed onto or into a plant element, any or all of the endophytes may be capable of conferring a beneficial trait onto the host plant. In some embodiments, all of the endophytes are capable of conferring a beneficial trait onto the host plant. The trait conferred by each of the endophytes may be the same (e.g., both improve the host plant's tolerance to a particular biotic stress), or may be distinct (e.g., one improves the host plant's tolerance to drought, while another improves phosphate utilization). In some embodiments, the conferred trait may be the result of interactions between the endophytes. Alternatively, two or more endophytes induce the colonization of a third endophyte. For example, the first population of endophytes is selected on the basis that it confers significant increase in biomass, while the second population promotes increased drought tolerance on the inoculated agricultural plant. Therefore, in some embodiments, the first population is capable of conferring at least one trait selected from the group consisting of thermal tolerance, herbicide tolerance, drought resistance, insect resistance, fungus resistance, virus resistance, bacteria resistance, male sterility, cold tolerance, salt tolerance, increased yield, enhanced nutrient use efficiency, increased nitrogen use efficiency, increased tolerance to nitrogen stress, increased fermentable carbohydrate content, reduced lignin content, increased antioxidant content, enhanced water use efficiency, increased vigor, increased germination efficiency, earlier or increased flowering, increased biomass, altered root-to-shoot biomass ratio, enhanced soil water retention, or a combination thereof. In other embodiments, the second population is capable of conferring a trait selected from the group consisting of thermal tolerance, herbicide tolerance, drought resistance, insect resistance, fungus resistance, virus resistance, bacteria resistance, male sterility, cold tolerance, salt tolerance, increased yield, enhanced nutrient use efficiency, increased nitrogen use efficiency, increased fermentable carbohydrate content, reduced lignin content, increased antioxidant content, enhanced water use efficiency, increased vigor, increased germination efficiency, earlier or increased flowering, increased biomass, altered root-to-shoot biomass ratio, and enhanced soil water retention. In still another embodiment, each of the first and second population is capable of conferring a different trait selected from the group consisting of thermal tolerance, herbicide tolerance, drought resistance, insect resistance, fungus resistance, virus resistance, bacteria resistance, male sterility, cold tolerance, salt tolerance, increased yield, enhanced nutrient use efficiency, increased nitrogen use efficiency, increased fermentable carbohydrate content, reduced lignin content, increased antioxidant content, enhanced water use efficiency, increased vigor, increased germination efficiency, earlier or increased flowering, increased biomass, altered root-to-shoot biomass ratio, and enhanced soil water retention. In any plurality of endophytes, any of the following traits of agronomic importance may be modulated due to the association of one or more of the endophytes with a plant or plant element: altered oil content, altered protein content, altered seed carbohydrate composition, altered seed oil composition, and altered seed protein composition, chemical tolerance, cold tolerance, delayed senescence, disease resistance, drought tolerance, ear weight, growth improvement, health enhancement, heat tolerance, herbicide tolerance, herbivore resistance, improved nitrogen fixation, improved nitrogen utilization, improved root architecture, improved water use efficiency, increased biomass, increased root length, increased seed weight, increased shoot length, increased yield, increased yield under water-limited conditions, kernel mass, kernel moisture content, metal tolerance, number of ears, number of kernels per ear, number of pods, nutrition enhancement, pathogen resistance, pest resistance, photosynthetic capability improvement, salinity tolerance, stay-green, vigor improvement, increased dry weight of mature seeds, increased fresh weight of mature seeds, increased number of mature seeds per plant, increased chlorophyll content, increased number of pods per plant, increased length of pods per plant, reduced number of wilted leaves per plant, reduced number of severely wilted leaves per plant, and increased number of non-wilted leaves per plant, a detectable modulation in the level of a metabolite, a detectable modulation in the level of a transcript, or a detectable modulation in the proteome relative to a reference plant.

The plurality of endophytes can also be selected based on combinations of the above criteria. For example, the first population of endophytes can be selected on the basis of the compound it produces (e.g., its ability to fix nitrogen, thus providing a potential nitrogen source to the plant), while the second population can be selected on the basis of its ability to confer increased resistance of the plant to a pathogen (e.g., a fungal pathogen).

Plants Useful for the Present Invention

Methods and compositions described herein can be deployed for any seed plant species. Thus, the invention has use over a broad range of plants, preferably higher plants pertaining to the classes of Angiospermae and Gymnospermae. In still another embodiment, the plant element of the first plant can be from a genetically modified plant. In other embodiments, the plant element of the first plant can be a hybrid plant element.

In some embodiments, a monocotyledonous plant is used. Monocotyledonous plants belong to the orders of the Alismatales, Arales, Arecales, Bromeliales, Commelinales, Cyclanthales, Cyperales, Eriocaulales, Hydrocharitales, Juncales, Lilliales, Najadales, Orchidales, Pandanales, Poales, Restionales, Triuridales, Typhales, and Zingiberales. Plants belonging to the class of the Gymnospermae are Cycadales, Ginkgoales, Gnetales, and Pinales. In a particular embodiment, the monocotyledonous plant are selected from the group consisting of a maize, rice, wheat, barley, sorghum, and sugarcane.

In other embodiments, a dicotyledonous plant is used, including those belonging to the orders of the Aristochiales, Asterales, Batales, Campanulales, Capparales, Caryophyllales, Casuarinales, Celastrales, Cornales, Diapensales, Dilleniales, Dipsacales, Ebenales, Ericales, Eucomiales, Euphorbiales, Fabales, Fagales, Gentianales, Geraniales, Haloragales, Hamamelidales, Middles, Juglandales, Lamiales, Laurales, Lecythidales, Leitneriales, Magniolales, Malvales, Myricales, Myrtales, Nymphaeales, Papeverales, Piperales, Plantaginales, Plumb aginales, Podostemales, Polemoniales, Polygalales, Polygonales, Primulales, Proteales, Rafflesiales, Ranunculales, Rhamnales, Rosales, Rubiales, Salicales, Santales, Sapindales, Sarraceniaceae, Scrophulariales, Theales, Trochodendrales, Umbellales, Urticales, and Violates. In a particular embodiment, the dicotyledonous plant can be selected from the group consisting of cotton, soybean, pepper, rapeseed, canola, and tomato.

The present invention contemplates the use of a plurality of endophytes derived from plants. It is contemplated that the plants may be agricultural plants. In some embodiments, a cultivar or variety that is of the same family as the plant from which the endophytes are derived is used. In some embodiments, a cultivar or variety that is of the same genus as the plant from which the endophytes are derived is used. In some embodiments, a cultivar or variety that is of the same species as the ancestral plant from which the endophytes are derived is used. In some embodiments, a modern cultivar or variety that is of the same family as the ancestral plant from which the endophytes are derived is used. In other embodiments, a modern cultivar or variety that is of the same genus as the ancestral plant from which the endophytes are derived used. In still another embodiment, a modern cultivar or variety that is of the same species as the ancestral plant from which the endophytes are derived is used.

The methods and compositions of the present invention are preferably used in plants that are important or interesting for agriculture, horticulture, biomass for the production of biofuel molecules and other chemicals, and/or forestry. Non-limiting examples include, for instance, *Panicum virgatum* (switch), *Sorghum bicolor* (sorghum, sudan), *Miscanthus giganteus* (miscanthus), *Saccharum* sp. (energycane), *Populus balsamifera* (poplar), *Zea mays* (corn), *Glycine max* (soybean), *Brassica napus* (canola), *Triticum aestivum* (wheat), *Gossypium hirsutum* (cotton), *Oryza sativa* (rice), *Helianthus annuus* (sunflower), *Medicago sativa* (alfalfa), *Beta vulgaris* (sugarbeet), *Pennisetum glaucum* (pearl millet), *Panicum* spp., Sorghum spp., *Miscanthus* spp., *Saccharum* spp., *Erianthus* spp., *Populus* spp., *Secale cereale* (rye), Salix spp. (willow), *Eucalyptus* spp. (*eucalyptus*), *Triticosecale* spp. (*triticum*—wheat X rye), Bamboo, Carthamus tinctorius (safflower), Jatropha curcas (Jatropha), *Ricinus communis* (castor), *Elaeis guineensis* (oil palm), *Phoenix dactylifera* (date palm), *Archontophoenix cunninghamiana* (king palm), *Syagrus romanzoffiana* (queen palm), *Linum usitatissimum* (flax), *Brassica juncea, Manihot esculenta* (cassava), *Lycopersicon esculentum* (tomato), *Lactuca saliva* (lettuce), *Musa paradisiaca* (banana), *Solanum tuberosum* (potato), *Brassica oleracea* (broccoli, cauliflower, brusselsprouts), *Camellia sinensis* (tea), Fragaria ananassa (strawberry), *Theobroma cacao* (cocoa), *Coffea arabica* (coffee), *Vitis vinifera* (grape), *Ananas comosus* (pineapple), *Capsicum* annum (hot & sweet pepper), *Allium cepa* (onion), *Cucumis melo* (melon), *Cucumis sativus* (cucumber), *Cucurbita maxima* (squash), *Cucurbita moschata* (squash), *Spinacea oleracea* (spinach), *Citrullus lanatus* (watermelon), *Abelmoschus esculentus* (okra), *Solanum melongena* (eggplant), *Papaver somniferum* (opium poppy), *Papaver orientale, Taxus baccata, Taxus brevifolia, Artemisia annua, Cannabis* saliva, *Camptotheca acuminate, Catharanthus roseus, Vinca rosea, Cinchona officinalis, Colchicum autumnale, Veratrum californica, Digitalis lanata, Digitalis purpurea, Dioscorea* spp., *Andrographis paniculata, Atropa belladonna, Datura stomonium, Berberis* spp., *Cephalotaxus* spp., *Ephedra sinica, Ephedra* spp., *Erythroxylum coca, Galanthus* wornorii, *Scopolia* spp., *Lycopodium serratum* (*Huperzia serrata*), *Lycopodium* spp., Rauwolfia *serpentina*, Rauwolfia spp., *Sanguinaria canadensis, Hyoscyamus* spp., *Calendula officinalis, Chrysanthemum parthenium, Coleus forskohlii, Tanacetum parthenium, Parthenium argentatum* (guayule), *Hevea* spp. (rubber), *Mentha spicata* (mint), *Mentha piperita* (mint), *Bixa orellana, Alstroemeria* spp., *Rosa* spp. (rose), *Dianthus caryophyllus* (carnation), *Petunia* spp. (*petunia*), *Poinsettia*

*pulcherrima* (poinsettia), *Nicotiana tabacum* (tobacco), *Lupinus albus* (lupin), *Uniola paniculata* (oats), *Hordeum vulgare* (barley), and *Lolium* spp. (rye).

The present invention contemplates improving an agronomic trait in an agricultural plant by heterologously disposing onto a modern agricultural plant a formulation comprising a plurality of endophytes derived from a plant or a plurality of endophytes conserved across diverse species and/or cultivars of agricultural plants. In some embodiments, the modern agricultural plant is a hybrid plant. In other embodiments, the modern agricultural plant is an inbred plant. Non-limiting examples of such hybrid, inbred and genetically modified plants are described herein. In still another embodiment the modern agricultural plant is a modified plant. In still another embodiment the modern agricultural plant is a GM plant. The methods described herein can also be used with modified plants, for example, to yield additional trait benefits to a plant. In some embodiments, the modern agricultural plant is a modified plant that that confers in the plant a phenotype selected from the group consisting of: increased germination rate, increased disease resistance, increased heat tolerance, increased drought tolerance, increased water use efficiency, increased cold tolerance, increased salinity tolerance, increased metal tolerance, increased herbicide tolerance, increased chemical tolerance, increased nitrogen utilization, increased nitrogen use efficiency, resistance to nitrogen stress, increased tolerance to low nitrogen stress, improved nitrogen fixation, increased pest resistance, increased herbivore resistance, increased pathogen resistance, increased insect resistance, increased yield, increased yield under water-limited conditions, increased grain or fruit mass, kernel moisture content, increased number of ears, increased number of kernels per ear, health enhancement, increased vigor improvement, growth improvement, photosynthetic capability improvement, nutrition enhancement, altered protein content, altered oil content, increased biomass, increased root biomass, increased root length, increased root surface area, improved root architecture, increased shoot length, increased shoot height, increased shoot biomass, increased seed weight, altered seed carbohydrate composition, altered seed oil composition, increased number of pods, delayed senescence, stay-green, altered seed protein composition, increased dry weight of mature seeds, increased fresh weight of mature seeds, increased number of mature seeds per plant, increased chlorophyll content, increased photosynthesis rate, increased number of leaves, increased number of pods per plant, increased length of pods per plant, reduced number of wilted leaves per plant, reduced number of severely wilted leaves per plant, increased number of non-wilted leaves per plant, increased resistance to a fungal pathogen, increased resistance to a bacterial pathogen, increased resistance to a viral pathogen, increased resistance to a nematode, a detectable modulation in the level of a metabolite, a detectable modulation in gene expression, and a detectable modulation in the proteome, or any combination thereof.

Beneficial Attributes of Synthetic Combinations of Plant Elements and Endophytes Colonization by endophytes. In some embodiments, disclosed herein is a plant element of an agricultural plant comprising an isolated population of a plurality of endophytes that are heterologously disposed on an exterior surface of or within the plant in an amount effective to colonize the plant. For example, the plurality of endophytes that are heterologously disposed on an exterior surface or within the plant element can be endophytes that may be associated with the mature plant, but are not found on the surface of or within the plant element. Alternatively, the plurality of endophytes can be found on the surface of, or within the plant element, but at a much lower number than is heterologously disposed.

In some embodiments, the plurality of endophytes can be applied to the plant, for example the plant seed, or by foliar application, and successful colonization can be confirmed by detecting the presence of the plurality of endophytes within the plant. For example, after applying the plurality of endophytes to the seeds, high titers of the endophytes can be detected in the roots and shoots of the plants that germinate from the seeds. In addition, significant quantities of the endophytes can be detected in the rhizosphere of the plants. Therefore, in some embodiments, the plurality of endophytes are heterologously disposed in an amount effective to colonize the plant. In some embodiments, colonization of the plant can be detected, for example, by detecting the presence of the endophytes inside the plant. This can be accomplished by measuring the viability of the endophytes after surface sterilization of the plant element: endophytic colonization results in an internal localization of the microbe, rendering it resistant to conditions of surface sterilization. The presence and quantity of the endophytes can also be established using other means known in the art, for example, immunofluorescence microscopy using microbe specific antibodies, or fluorescence in situ hybridization. Alternatively, specific nucleic acid probes recognizing conserved sequences from the endophytes can be employed to amplify a region, for example by quantitative PCR, and correlated to CFUs by means of a standard curve.

In other embodiments, the plurality of endophytes are heterologously disposed, for example, on the surface of a plant element of an agricultural plant, in an amount effective to be detectable in the mature agricultural plant. In some embodiments, the plurality of endophytes are heterologously disposed in an amount effective to be detectable in an amount of at least about 100 CFU or spores, between 100 and 200 CFU or spores, at least about 200 CFU or spores, between 200 and 300 CFU or spores, at least about 300 CFU or spores, between 300 and 400 CFU or spores, at least about 500 CFU or spores, between 500 and 1,000 CFU or spores, at least about 1,000 CFU or spores, between 1,000 and 3,000 CFU or spores, at least about 3,000 CFU or spores, between 3,000 and 10,000 CFU or spores, at least about 10,000 CFU or spores, between 10,000 and 30,000 CFU or spores, at least about 30,000 CFU or spores, between 30,000 and 100,000 CFU or spores, at least about 100,000 CFU or spores, between 100,000 and $10^6$ CFU or spores at least about $10^6$ CFU or spores or more in the mature agricultural plant.

In some embodiments, the plurality of endophytes are capable of colonizing particular tissue types of the plant. In some embodiments, the plurality of endophytes are heterologously disposed on the plant element in an amount effective to be detectable within a target tissue of the mature agricultural plant selected from a fruit, a seed, a leaf, or a root, or portion thereof. For example, the plurality of endophytes can be detected in an amount of at least about 100 CFU or spores or spores, between 100 and 200 CFU or spores, at least about 200 CFU or spores, between 200 and 300 CFU or spores, at least about 300 CFU or spores, between 300 and 400 CFU or spores, at least about 500 CFU or spores, between 500 and 1,000 CFU or spores, at least about 1,000 CFU or spores, between 1,000 and 3,000 CFU or spores, at least about 3,000 CFU or spores, between 3,000 and 10,000 CFU or spores, at least about 10,000 CFU or spores, between 10,000 and 30,000 CFU or spores, at least about 30,000 CFU or spores, between 30,000 and 100,000 CFU or spores, at least about 100,000 CFU or spores, between 100,000 and 10^6 CFU or spores at least about 10^6 CFU or spores or more in the mature agricultural plant.

In some embodiments, the endophytes described herein are capable of moving from one tissue type to another. In some embodiments, at least one type of the plurality of endophytes are capable of moving from the seed exterior into the vegetative tissues of a plant. In some embodiments, at least one type of the plurality of endophytes that are coated onto the seed of a plant are capable, upon germination of the seed into a vegetative state, of localizing to a different tissue of the plant. For example, endophytes can be capable of localizing to any one of the tissues in the plant, including: the root, adventitious root, seminal root, root hair, shoot, leaf, flower, bud, tassel, meristem, pollen, pistil, ovaries, stamen, fruit, stolon, rhizome, nodule, tuber, trichome, guard cells, hydathode, petal, sepal, glume, rachis, vascular cambium, phloem, and xylem. In some embodiments, at least one type of the plurality of endophytes are capable of localizing to the root and/or the root hair of the plant. In other embodiments, at least one type of the plurality of endophytes are capable of localizing to the photosynthetic tissues, for example, leaves and shoots of the plant. In other cases, at least one type of the plurality of endophytes are localized to the vascular tissues of the plant, for example, in the xylem and phloem. In still another embodiment, at least one type of the plurality of endophytes are capable of localizing to the reproductive tissues (flower, pollen, pistil, ovaries, stamen, fruit) of the plant. In other embodiments, at least one type of the plurality of endophytes are capable of localizing to the root, shoots, leaves and reproductive tissues of the plant. In still another embodiment, at least one type of the plurality of endophyte colonizes a fruit or seed tissue of the plant. In still another embodiment, at least one type of the plurality of endophytes are able to colonize the plant such that it is present in the surface of the plant (i.e., endophyte presence is detectably present on the plant exterior, or the episphere of the plant). In still other embodiments, at least one type of the plurality of endophytes are capable of localizing to substantially all, or all, tissues of the plant. In certain embodiments, at least one type of the plurality of endophytes are not localized to the root of a plant. In other cases, at least one type of the plurality of endophytes are not localized to the photosynthetic tissues of the plant.

In some embodiments, the plurality of endophytes heterologously disposed on the plant element can be detected in the rhizosphere. In some embodiments, the rhizosphere-localized microbe can secrete compounds (such as siderophores or organic acids) that assist with nutrient acquisition by the plant. Therefore, in other embodiments, the plurality of endophytes are heterologously disposed on the plant element in an amount effective to detectably colonize the soil environment surrounding the mature agricultural plant when compared with a reference agricultural plant. For example, the microbe can be detected in an amount of at least 100 CFU or spores/g DW, for example, at least 200 CFU or spores/g DW, at least 500 CFU or spores/g DW, at least 1,000 CFU or spores/g DW, at least 3,000 CFU or spores/g DW, at least 10,000 CFU or spores/g DW, at least 30,000 CFU or spores/g DW, at least 100,000 CFU or spores/g DW, at least 300,000 CFU or spores/g DW, or more, in the rhizosphere.

Improved attributes conferred by endophytes. In some embodiments, endophyte inoculation results in a detectable change to the plant element, in particular the seed or the whole plant. The detectable change can be an improvement in a number of agronomic traits (e.g., improved general health, increased response to biotic or abiotic stresses, or enhanced properties of the plant or a plant element, including fruits and grains). Alternatively, the detectable change can be a physiological or biological change that can be measured by methods known in the art. The detectable changes are described in more detail herein. As used herein, a plurality of endophytes are considered to have conferred an improved agricultural trait whether or not the improved trait arose from the plant, the endophytes, or the concerted action between the plant and endophyte. Therefore, for example, whether a beneficial hormone or chemical is produced by the plant or the endophytes, for purposes of the present invention, the endophytes will be considered to have conferred an improved agronomic trait upon the host plant.

In some embodiments, plant-endophyte combinations confer an agronomic benefit in agricultural plants. In some embodiments, the agronomic trait is selected from the group consisting of germination rate, disease resistance, heat tolerance, drought tolerance, water use efficiency, cold tolerance, salinity tolerance, metal tolerance, herbicide tolerance, chemical tolerance, nitrogen utilization, nutrient utilization, resistance to nitrogen stress, nitrogen fixation, pathogen resistance, insect resistance, yield, yield under water-limited conditions, grain weight, fruit weight, kernel moisture content, number of ears, number of kernels per ear, health enhancement, vigor, growth, photosynthetic capability, nutrition enhancement, altered protein content, altered oil content, biomass, root biomass, root length, root surface area, root architecture, shoot length, shoot height, shoot biomass, seed weight, seed carbohydrate composition, seed oil composition, number of pods, delayed senescence, stay-green, seed protein composition, dry weight of mature seeds, fresh weight of mature seeds, number of mature seeds per plant, number of flowers per plant, chlorophyll content, rate of photosynthesis, number of leaves, number of pods per plant, length of pods per plant, number of wilted leaves per plant, number of severely wilted leaves per plant, number of non-wilted leaves per plant, resistance to a fungal pathogen, resistance to a bacterial pathogen, resistance to a viral pathogen, resistance to a nematode, a detectable modulation in the level of a metabolite, a detectable modulation in gene expression, and a detectable modulation in the proteome. In other embodiments, at least two agronomic traits are improved in the agricultural plant.

For example, the endophyte may provide an improved benefit or tolerance to a plant that is of at least 3%, between 3% and 5%, at least 5%, between 5% and 10%, least 10%, between 10% and 15%, for example at least 15%, between 15% and 20%, at least 20%, between 20% and 30%, at least 30%, between 30% and 40%, at least 40%, between 40% and 50%, at least 50%, between 50% and 60%, at least 60%, between 60% and 75%, at least 75%, between 75% and 100%, at least 100%, between 100% and 150%, at least 150%, between 150% and 200%, at least 200%, between 200% and 300%, or at least 300% or more, when compared with uninoculated plants grown under the same conditions.

Improved general health. Also described herein are plants, and fields of plants, that are manually, mechanically, or artificially inoculated with beneficial endophytes, such that the overall fitness, productivity or health of the plant or a portion thereof, is maintained, increased and/or improved over a period of time. Improvement in overall plant health can be assessed using numerous physiological parameters including, but not limited to, height, overall biomass, root and/or shoot biomass, seed germination, seedling survival, photosynthetic efficiency, transpiration rate, seed/fruit number or mass, plant grain or fruit yield, leaf chlorophyll content, photosynthetic rate, root length, or any combination thereof. Improved plant health, or improved field health, can also be demonstrated through improved resistance or response to a given stress, either biotic or abiotic stress, or a combination of one or more biotic or abiotic stresses, as provided herein.

Other abiotic stresses. Disclosed herein are endophyte-inoculated plants with increased resistance to an abiotic stress. Exemplary abiotic stresses include, but are not limited to: drought stress, salt stress, metal stress, heat stress, cold stress, low nutrient stress, excess water stress, and combinations thereof.

Drought and heat tolerance. When soil water is depleted or if water is not available during periods of drought, crop yields are restricted. Plant water deficit develops if transpiration from leaves exceeds the supply of water from the roots. The available water supply is related to the amount of water held in the soil and the ability of the plant to reach that water with its root system. Transpiration of water from leaves is linked to the fixation of carbon dioxide by photosynthesis through the stomata. The two processes are positively correlated so that high carbon dioxide influx through photosynthesis is closely linked to water loss by transpiration. As water transpires from the leaf, leaf water potential is reduced and the stomata tend to close in a hydraulic process limiting the amount of photosynthesis. Since crop yield is dependent on the fixation of carbon dioxide in photosynthesis, water uptake and transpiration are contributing factors to crop yield. Plants which are able to use less water to fix the same amount of carbon dioxide or which are able to function normally at a lower water potential have the potential to conduct more photosynthesis and thereby to produce more biomass and economic yield in many agricultural systems.

In some cases, a plant resulting from seeds or other plant elements treated with a plurality of endophytes can exhibit a physiological change, such as a compensation of the stress-induced reduction in photosynthetic activity (expressed, for example, as $\Delta Fv/Fm$) after exposure to heat shock or drought conditions as compared to a corresponding control, genetically identical plant that does not contain the endophytes grown in the same conditions. In some cases, the endophyte-inoculated plant as disclosed herein can exhibit an increased change in photosynthetic activity $\Delta Fv(\Delta Fv/Fm)$ after heat-shock or drought stress treatment, for example 1, 2, 3, 4, 5, 6, 7 days or more after the heat-shock or drought stress treatment, or until photosynthesis ceases, as compared with corresponding control plant of similar developmental stage but not comprising the endophytes. For example, a plant having a plurality of the endophytes able to confer heat and/or drought-tolerance can exhibit a $\Delta Fv/Fm$ of from about 0.1 to about 0.8 after exposure to heat-shock or drought stress or a $\Delta Fv/Fm$ range of from about 0.03 to about 0.8 under one day, or 1, 2, 3, 4, 5, 6, 7, or over 7 days post heat-shock or drought stress treatment, or until photosynthesis ceases. In some embodiments, stress-induced reductions in photosynthetic activity can be compensated by at least about 0.25% (for example, at least about 0.5%, between 0.5% and 1%, at least about 1%, between 1% and 2%, at least about 2%, between 2% and 3%, at least about 3%, between 3% and 5%, at least about 5%, between 5% and 10%, at least about 8%, at least about 10%, between 10% and 15%, at least about 15%, between 15% and 20%, at least about 20%, between 20$ and 25%, at least about 25%, between 25% and 30%, at least about 30%, between 30% and 40%, at least about 40%, between 40% and 50%, at least about 50%, between 50% and 60%, at least about 60%, between 60% and 75%, at least about 75%, between 75% and 80%, at least about 80%, between 80% and 85%, at least about 85%, between 85% and 90%, at least about 90%, between 90% and 95%, at least about 95%, between 95% and 99%, at least about 99%, between 99% and 100%, or at least 100%) as compared to the photosynthetic activity decrease in a corresponding reference agricultural plant following heat shock conditions. Significance of the difference between endophyte-inoculated and reference agricultural plants can be established upon demonstrating statistical significance, for example at $p<0.05$ with an appropriate parametric or non-parametric statistic, e.g., Chi-square test, Student's t-test, Mann-Whitney test, or F-test based on the assumption or known facts that the endophyte-inoculated plant and reference agricultural plant have identical or near identical genomes (isoline comparison).

In selecting traits for improving crops, decrease in water use, without a change in growth has particular merit in an irrigated agricultural system where the water input costs are high. An increase in growth without a corresponding jump in water use would have applicability to all agricultural systems. In many agricultural systems where water supply is not limiting, an increase in growth, even if it came at the expense of an increase in water use also increases yield. Water use efficiency (WUE) is a parameter often correlated with drought tolerance, and is the CO2 assimilation rate per water transpired by the plant. An increased water use efficiency of the plant relates in some cases to an increased fruit/kernel size or number. Therefore, in some embodiments, the plants described herein exhibit an increased water use efficiency when compared with a reference agricultural plant grown under the same conditions. For example, the plants grown from the plant elements comprising the plurality of endophytes can have at least 3%, between 3% and 5%, at least 5%, between 5% and 10%, least 10%, between 10% and 15%, for example at least 15%, between 15% and 20%, at least 20%, between 20% and 30%, at least 30%, between 30% and 40%, at least 40%, between 40% and 50%, at least 50%, between 50% and 60%, at least 60%, between 60% and 75%, at least 75%, between 75% and 100%, or at least 100% higher WUE than a reference agricultural plant grown under the same conditions.

Such an increase in WUE can occur under conditions without water deficit, or under conditions of water deficit, for example, when the soil water content is less than or equal to 60% of water saturated soil, for example, less than or equal to 50%, less than or equal to 40%, less than or equal to 30%, less than or equal to 20%, less than or equal to 10% of water saturated soil on a weight basis. In some embodiments, the plant comprising the plurality of endophytes can have at least 10% higher relative water content (RWC), for example, at least 3%, between 3% and 5%, at least 5%, between 5% and 10%, least 10%, between 10% and 15%, for example at least 15%, between 15% and 20%, at least 20%, between 20% and 30%, at least 30%, between 30% and 40%, at least 40%, between 40% and 50%, at least 50%, between 50% and 60%, at least 60%, between 60% and 75%, at least 75%, between 75% and 100%, or at least 100% higher RWC than a reference agricultural plant grown under the same conditions.

In some embodiments, the plants comprise a plurality of endophytes able to increase heat and/or drought-tolerance in sufficient quantity, such that increased growth or improved recovery from wilting under conditions of heat or drought stress is observed. For example, a plurality of endophyte populations described herein can be present in sufficient quantity in a plant, resulting in increased growth as compared to a plant that does not contain endophytes, when grown under drought conditions or heat shock conditions, or following such conditions. Increased heat and/or drought tolerance can be assessed with physiological parameters including, but not limited to, increased height, overall biomass, root and/or shoot biomass, seed germination, seedling survival, photosynthetic efficiency, transpiration rate, seed/fruit number or mass, plant grain or fruit yield, leaf chlorophyll content, photosynthetic rate, root length, wilt recovery, turgor pressure, or any combination thereof, as compared to a reference agricultural plant grown under similar conditions. For example, the endophyte may provide an improved benefit or tolerance to a plant that is of at least 3%, between 3% and 5%, at least 5%, between 5% and 10%, least 10%, between 10% and 15%, for example at least 15%, between 15% and 20%, at least 20%, between 20% and 30%, at least 30%, between 30% and 40%, at least 40%, between 40% and 50%, at least 50%, between 50% and 60%, at least 60%, between 60% and 75%, at least 75%, between 75% and 100%, or at least 100%, when compared with uninoculated plants grown under the same conditions.

In some embodiments, a plurality of endophytes heterologously disposed onto a seed confers in the resulting plant thermal tolerance, herbicide tolerance, drought resistance, insect resistance, fungus resistance, virus resistance, bacteria resistance, male sterility, cold tolerance, salt tolerance, increased yield, enhanced nutrient use efficiency, increased nitrogen use efficiency, increased protein content, increased fermentable carbohydrate content, reduced lignin content, increased antioxidant content, enhanced water use efficiency, increased vigor, increased germination efficiency, earlier or increased flowering, increased biomass, altered root-to-shoot biomass ratio, enhanced soil water retention, or a combination thereof. A difference between the endophyte-inoculated plant and a reference agricultural plant can also be measured using other methods known in the art.

Salt Stress. In other embodiments, a plurality of endophytes able to confer increased tolerance to salinity stress can be introduced into plants. The resulting plants comprising endophytes can exhibit increased resistance to salt stress, whether measured in terms of survival under saline conditions, or overall growth during, or following salt stress. The physiological parameters of plant health recited above, including height, overall biomass, root and/or shoot biomass, seed germination, seedling survival, photosynthetic efficiency, transpiration rate, seed/fruit number or mass, plant grain or fruit yield, leaf chlorophyll content, photosynthetic rate, root length, or any combination thereof, can be used to measure growth, and compared with the growth rate of reference agricultural plants (e.g., isoline plants without the endophytes) grown under identical conditions. For example, the endophyte may provide an improved benefit or tolerance to a plant that is of at least 3%, between 3% and 5%, at least 5%, between 5% and 10%, least 10%, between 10% and 15%, for example at least 15%, between 15% and 20%, at least 20%, between 20% and 30%, at least 30%, between 30% and 40%, at least 40%, between 40% and 50%, at least 50%, between 50% and 60%, at least 60%, between 60% and 75%, at least 75%, between 75% and 100%, or at least 100%, when compared with uninoculated isoline plants grown under the same conditions.

In other instances, endophyte-inoculated plants and reference agricultural plants can be grown in soil or growth media comprising different concentration of sodium to establish the inhibitory concentration of sodium (expressed, for example, as the concentration in which growth of the plant is inhibited by 50% when compared with plants grown under no sodium stress). Therefore, in other embodiments, a plant resulting from plant elements comprising a plurality of endophytes able to confer salt tolerance described herein exhibits an increase in the inhibitory sodium concentration by at least 10 mM, between 10 mM and 15 mM, for example at least 15 mM, between 15 mM and 20 mM, at least 20 mM, between 20 mM and 30 mM, at least 30 mM, between 30 mM and 40 mM, at least 40 mM, between 40 mM and 50 mM, at least 50 mM, between 50 mM and 60 mM, at least 60 mM, between 60 mM and 70 mM, at least 70 mM, between 70 mM and 80 mM, at least 80 mM, between 80 mM and 90 mM, at least 90 mM, between 90 mM and 100 mM, or at least 100 mM or more, when compared with the reference agricultural plants.

High Metal Content. Plants are sessile organisms and therefore must contend with the environment in which they are placed. Plants have adapted many mechanisms to deal with chemicals and substances that may be deleterious to their health. Heavy metals in particular represent a class of toxins that are highly relevant for plant growth and agriculture, because many of them are associated with fertilizers and sewage sludge used to amend soils and can accumulate to toxic levels in agricultural fields. Therefore, for agricultural purposes, it is important to have plants that are able to tolerate soils comprising elevated levels of toxic heavy metals. Plants cope with toxic levels of heavy metals (for example, nickel, cadmium, lead, mercury, arsenic, or aluminum) in the soil by excretion and internal sequestration. A plurality of endophytes that is able to confer increased heavy metal tolerance may do so by enhancing sequestration of the metal in certain compartments away from the seed or fruit and/or by supplementing other nutrients necessary to remediate the stress. Use of such endophytes in a plant would allow the development of novel plant-endophyte combinations for purposes of environmental remediation (also known as phytoremediation). Therefore, in some embodiments, the plant comprising endophytes shows increased metal tolerance as compared to a reference agricultural plant grown under the same heavy metal concentration in the soil.

Alternatively, the inhibitory concentration of the heavy metal can be determined for endophyte-inoculated plant and compared with a reference agricultural plant under the same conditions. Therefore, in some embodiments, the plants resulting from plant elements comprising a plurality of endophytes that is able to confer heavy metal tolerance described herein exhibit an increase in the inhibitory sodium concentration by at least 0.1 mM, between 0.1 mM and 0.3 mM, for example at least 0.3 mM, between 0.3 mM and 0.5 mM, at least 0.5 mM, between 0.5 mM and 1 mM, at least 1 mM, between 1 mM and 2 mM, at least 2 mM, between 2 mM and 5 mM, at least 5 mM, between 5 mM and 10 mM, at least 10 mM, between 10 mM and 15 mM, at least 15 mM, between 15 mM and 20 mM, at least 20 mM, between 20 mM and 30 mM, at least 30 mM, between 30 mM and 50 mM, at least 50 mM or more, when compared with the reference agricultural plants.

Finally, plants inoculated with a plurality of endophytes that is able to confer increased metal tolerance exhibit an increase in overall metal excretion by at least 3%, between 3% and 5%, at least 5%, between 5% and 10%, least 10%, between 10% and 15%, for example at least 15%, between 15% and 20%, at least 20%, between 20% and 30%, at least 30%, between 30% and 40%, at least 40%, between 40% and 50%, at least 50%, between 50% and 60%, at least 60%, between 60% and 75%, at least 75%, between 75% and 100%, or at least 100%, when compared with uninoculated plants grown under the same conditions.

Low Nutrient Stress. A plurality of endophytes described herein may also confer to the plant an increased ability to grow in nutrient limiting conditions, for example by solubilizing or otherwise making available to the plants macronutrients or micronutrients that are complexed, insoluble, or otherwise in an unavailable form. In some embodiments, a plant is inoculated with a plurality of endophytes that confer increased ability to liberate and/or otherwise provide to the plant with nutrients selected from the group consisting of phosphate, nitrogen, potassium, iron, manganese, calcium, molybdenum, vitamins, or other micronutrients. Such a plant can exhibit increased growth in soil comprising limiting amounts of such nutrients when compared with reference agricultural plant. Differences between the endophyte-inoculated plant and reference agricultural plant can be measured by comparing the biomass of the two plant types grown under limiting conditions, or by measuring the physical parameters described above. Therefore, in some embodiments, the plant comprising endophytes shows increased tolerance to nutrient limiting conditions as compared to a reference agricultural plant grown under the same nutrient limited concentration in the soil, as measured for example by increased biomass or seed yield of at least 3%, between 3% and 5%, at least 5%, between 5% and 10%, least 10%, between 10% and 15%, for example at least 15%, between 15% and 20%, at least 20%, between 20% and 30%, at least 30%, between 30% and 40%, at least 40%, between 40% and 50%, at least 50%, between 50% and 60%, at least 60%, between 60% and 75%, at least 75%, between 75% and 100%, or at least 100%, when compared with uninoculated plants grown under the same conditions. In other embodiments, the plant containing the plurality of endophytes is able to grown under nutrient stress conditions while exhibiting no difference in the physiological parameter compared to a plant that is grown without nutrient stress. In some embodiments, such a plant will exhibit no difference in the physiological parameter when grown with 2-5% less nitrogen than average cultivation practices on normal agricultural land, for example, at least 10%, between 10% and 15%, for example at least 15%, between 15% and 20%, at least 20%, between 20% and 30%, at least 30%, between 30% and 40%, at least 40%, between 40% and 50%, at least 50%, between 50% and 60%, at least 60%, between 60% and 75%, at least 75%, or between 75% and 100%, less nitrogen, when compared with crop plants grown under normal conditions during an average growing season. In some embodiments, the microbe capable of providing nitrogen-stress tolerance to a plant is diazotrophic. In other embodiments, the microbe capable of providing nitrogen-stress tolerance to a plant is non-diazotrophic.

Cold Stress. In some cases, a plurality of endophytes can confer to the plant the ability to tolerate cold stress. Many known methods exist for the measurement of a plant's tolerance to cold stress. As used herein, cold stress refers to both the stress induced by chilling (0° C.-15° C.) and freezing (<0° C.). Some cultivars of agricultural plants can be particularly sensitive to cold stress, but cold tolerance traits may be multigenic, making the breeding process difficult. A plurality of endophytes able to confer cold tolerance would potentially reduce the damage suffered by farmers on an annual basis. Improved response to cold stress can be measured by survival of plants, production of protectant substances such as anthocyanin, the amount of necrosis of parts of the plant, or a change in crop yield loss, as well as the physiological parameters used in other examples. Therefore, in some embodiments, the plant comprising a plurality of endophytes shows increased cold tolerance exhibits as compared to a reference agricultural plant grown under the same conditions of cold stress. For example, the endophyte may provide an improved benefit or tolerance to a plant that is of at least 3%, between 3% and 5%, at least 5%, between 5% and 10%, least 10%, between 10% and 15%, for example at least 15%, between 15% and 20%, at least 20%, between 20% and 30%, at least 30%, between 30% and 40%, at least 40%, between 40% and 50%, at least 50%, between 50% and 60%, at least 60%, between 60% and 75%, at least 75%, between 75% and 100%, or at least 100%, when compared with uninoculated plants grown under the same conditions.

Biotic Stress. In other embodiments, the plurality of endophytes protects the plant from a biotic stress, for example, insect infestation, nematode infestation, complex infection, fungal infection, bacterial infection, oomycete infection, protozoal infection, viral infection, and herbivore grazing, or a combination thereof. For example, the endophyte may provide an improved benefit or tolerance to a plant that is of at least 3%, between 3% and 5%, at least 5%, between 5% and 10%, least 10%, between 10% and 15%, for example at least 15%, between 15% and 20%, at least 20%, between 20% and 30%, at least 30%, between 30% and 40%, at least 40%, between 40% and 50%, at least 50%, between 50% and 60%, at least 60%, between 60% and 75%, at least 75%, between 75% and 100%, or at least 100%, when compared with uninoculated plants grown under the same conditions.

Insect herbivory. There are an abundance of insect pest species that can infect or infest a wide variety of plants. Pest infestation can lead to significant damage. Insect pests that infest plant species are particularly problematic in agriculture as they can cause serious damage to crops and significantly reduce plant yields. A wide variety of different types of plant are susceptible to pest infestation including commercial crops such as cotton, soybean, wheat, barley, sorghum, canola, rice and corn.

In some cases, the plurality of endophytes described herein may confer upon the host plant the ability to repel insect herbivores. In other cases, the plurality of endophytes may produce, or induce the production in the plant of, compounds which are insecticidal or insect repellant. The insect may be any one of the common pathogenic insects affecting plants, particularly agricultural plants.

The endophyte-inoculated plant can be tested for its ability to resist, or otherwise repel, pathogenic insects by measuring, for example, insect load, overall plant biomass, biomass of the fruit or grain, percentage of intact leaves, or other physiological parameters described herein, and comparing with a reference agricultural plant. In some embodiments, the endophyte-inoculated plant exhibits increased biomass as compared to a reference agricultural plant grown under the same conditions (e.g., grown side-by-side, or adjacent to, the endophyte-inoculated plants, under conditions of pathogenic insect challenge). In other embodiments, the endophyte-inoculated plant exhibits increased root biomass as compared to a reference agricultural plant grown under the same conditions (e.g., grown side-by-side, or adjacent to, the endophyte-inoculated plants, under conditions of pathogenic insect challenge). In other embodiments, the endophyte-inoculated plant exhibits increased root length as compared to a reference agricultural plant grown under the same conditions (e.g., grown side-by-side, or adjacent to, the endophyte-inoculated plants, under conditions of pathogenic insect challenge). In other embodiments, the endophyte-inoculated plant exhibits increased root surface area as compared to a reference agricultural plant grown under the same conditions (e.g., grown side-by-side, or adjacent to, the endophyte-inoculated plants, under conditions of pathogenic insect challenge). In any of the above, the endophyte may provide an improved benefit or tolerance to a plant that is of at least 3%, between 3% and 5%, at least 5%, between 5% and 10%, least 10%, between 10% and 15%, for example at least 15%, between 15% and 20%, at least 20%, between 20% and 30%, at least 30%, between 30% and 40%, at least 40%, between 40% and 50%, at least 50%, between 50% and 60%, at least 60%, between 60% and 75%, at least 75%, between 75% and 100%, or at least 100%, when compared with uninoculated plants grown under the same conditions.

Nematodes. Nematodes are microscopic roundworms that feed on the roots, fluids, leaves and stems of more than 2,000 row crops, vegetables, fruits, and ornamental plants, causing an estimated $100 billion crop loss worldwide and accounting for 13% of global crop losses due to disease. A variety of parasitic nematode species infect crop plants, including root-knot nematodes, cyst- and lesion-forming nematodes. Root-knot nematodes, which are characterized by causing root gall formation at feeding sites, have a relatively broad host range and are therefore parasitic on a large number of crop species. The cyst- and lesion-forming nematode species have a more limited host range, but still cause considerable losses in susceptible crops.

Signs of nematode damage include stunting and yellowing of leaves, and wilting of the plants during hot periods. Nematode infestation, however, can cause significant yield losses without any obvious above-ground disease symptoms. The primary causes of yield reduction are due to underground root damage. Roots infected by root cyst nematodes are dwarfed or stunted. Nematode infestation also can decrease the number of nitrogen-fixing nodules on the roots, and may make the roots more susceptible to attacks by other soil-borne plant nematodes.

In some embodiments, the endophyte-inoculated plant has an increased resistance to a nematode when compared with a reference agricultural plant. As before with insect herbivores, biomass of the plant or a portion of the plant, or any of the other physiological parameters mentioned elsewhere, can be compared with the reference agricultural plant grown under the same conditions. Particularly useful measurements include overall plant biomass, biomass and/or size of the fruit or grain, and root length, root surface area, and root biomass. In some embodiments, the endophyte-inoculated plant exhibits increased biomass as compared to a reference agricultural plant grown under the same conditions (e.g., grown side-by-side, or adjacent to, the endophyte-inoculated plants, under conditions of nematode challenge). In other embodiments, the endophyte-inoculated plant exhibits increased root biomass as compared to a reference agricultural plant grown under the same conditions (e.g., grown side-by-side, or adjacent to, the endophyte-inoculated plants, under conditions of nematode challenge). In other embodiments, the endophyte-inoculated plant exhibits increased root length as compared to a reference agricultural plant grown under the same conditions (e.g., grown side-by-side, or adjacent to, the endophyte-inoculated plants, under conditions of nematode challenge). In other embodiments, the endophyte-inoculated plant exhibits increased root surface area as compared to a reference agricultural plant grown under the same conditions (e.g., grown side-by-side, or adjacent to, the endophyte-inoculated plants, under conditions of nematode challenge). In still another embodiment, the endophyte-inoculated plant exhibits increased fruit or grain yield as compared to a reference agricultural plant grown under the same conditions (e.g., grown side-by-side, or adjacent to, the endophyte-inoculated plants, under conditions of nematode challenge). In any of the above, the endophyte may provide an improved benefit or tolerance to a plant that is of at least 3%, between 3% and 5%, at least 5%, between 5% and 10%, least 10%, between 10% and 15%, for example at least 15%, between 15% and 20%, at least 20%, between 20% and 30%, at least 30%, between 30% and 40%, at least 40%, between 40% and 50%, at least 50%, between 50% and 60%, at least 60%, between 60% and 75%, at least 75%, between 75% and 100%, or at least 100%, when compared with uninoculated plants grown under the same conditions.

Fungal Pathogens. Fungal diseases are responsible for yearly losses of over $10 Billion on agricultural crops in the US, represent 42% of global crop losses due to disease, and are caused by a large variety of biologically diverse pathogens. Different strategies have traditionally been used to control them. Resistance traits have been bred into agriculturally important varieties, thus providing various levels of resistance against either a narrow range of pathogen isolates or races, or against a broader range. However, this involves the long and labor intensive process of introducing desirable traits into commercial lines by genetic crosses and, due to the risk of pests evolving to overcome natural plant resistance, a constant effort to breed new resistance traits into commercial lines is required. Alternatively, fungal diseases have been controlled by the application of chemical fungicides. This strategy usually results in efficient control, but is also associated with the possible development of resistant pathogens and can be associated with a negative impact on the environment. Moreover, in certain crops, such as barley and wheat, the control of fungal pathogens by chemical fungicides is difficult or impractical.

The present invention contemplates the use of a plurality of endophytes that is able to confer resistance to fungal pathogens to the host plant. Increased resistance to fungal inoculation can be measured, for example, using any of the physiological parameters presented above, by comparing with reference agricultural plants. In some embodiments, the endophyte-inoculated plant exhibits increased biomass and/or less pronounced disease symptoms as compared to a reference agricultural plant grown under the same conditions (e.g., grown side-by-side, or adjacent to, the endophyte-inoculated plants, infected with the fungal pathogen). In other embodiments, the endophyte-inoculated plant exhibits increased root length as compared to a reference agricultural plant grown under the same conditions (e.g., grown side-by-side, or adjacent to, the endophyte-inoculated plants, infected with the fungal pathogen). In other embodiments, the endophyte-inoculated plant exhibits increased root surface area as compared to a reference agricultural plant grown under the same conditions (e.g., grown side-by-side, or adjacent to, the endophyte-inoculated plants, infected with the fungal pathogen). In still another embodiment, the endophyte-inoculated plant exhibits increased fruit or grain yield as compared to a reference agricultural plant grown under the same conditions (e.g., grown side-by-side, or adjacent to, the endophyte-inoculated plants, infected with the fungal pathogen). In other embodiments, the endophyte-inoculated plant exhibits decreased hyphal growth as compared to a reference agricultural plant grown under the same conditions (e.g., grown side-by-side, or adjacent to, the endophyte-inoculated plants, infected with the fungal pathogen). In any of the above, the endophyte may provide an improved benefit or tolerance to a plant that is of at least 3%, between 3% and 5%, at least 5%, between 5% and 10%, least 10%, between 10% and 15%, for example at least 15%, between 15% and 20%, at least 20%, between 20% and 30%, at least 30%, between 30% and 40%, at least 40%, between 40% and 50%, at least 50%, between 50% and 60%, at least 60%, between 60% and 75%, at least 75%, between 75% and 100%, or at least 100%, when compared with uninoculated plants grown under the same conditions.

Viral Pathogens. Plant viruses are estimated to account for 18% of global crop losses due to disease. There are numerous examples of viral pathogens affecting agricultural productivity. In some embodiments, the plurality of endophytes provides protection against viral pathogens such that the plant has increased biomass as compared to a reference agricultural plant grown under the same conditions. In still another embodiment, the endophyte-inoculated plant exhibits greater fruit or grain yield, when challenged with a virus, as compared to a reference agricultural plant grown under the same conditions. In yet another embodiment, the endophyte-inoculated plant exhibits lower viral titer, when challenged with a virus, as compared to a reference agricultural plant grown under the same conditions.

Complex Pathogens. Likewise, endofungal bacterial pathogens are a significant problem negatively affecting agricultural productivity and accounting for 27% of global crop losses due to plant disease. In some embodiments, a plurality of endophytes provides protection against endofungal bacterial pathogens such that the plant has greater biomass as compared to a reference agricultural plant grown under the same conditions. In still another embodiment, the endophyte-inoculated plant exhibits greater fruit or grain yield, when challenged with a complex pathogen, as compared to a reference agricultural plant grown under the same conditions. In yet another embodiment, the endophyte-inoculated plant exhibits lower complex count, when challenged with a bacterium, as compared to a reference agricultural plant grown under the same conditions.

Yield and Biomass improvement. In some embodiments, the improved trait can be an increase in overall biomass of the plant or a part of the plant, including its fruit or seed. In some embodiments, a plurality of endophytes is disposed on the surface or within a tissue of the plant element in an amount effective to increase the biomass of the plant, or a part or tissue of the plant grown from the plant element. The increased biomass is useful in the production of commodity products derived from the plant. Such commodity products include an animal feed, a fish fodder, a cereal product, a processed human-food product, a sugar or an alcohol. Such products may be a fermentation product or a fermentable product, one such exemplary product is a biofuel. The increase in biomass can occur in a part of the plant (e.g., the root tissue, shoots, leaves, etc.), or can be an increase in overall biomass. Increased biomass production, such an increase meaning at at least 3%, between 3% and 5%, at least 5%, between 5% and 10%, least 10%, between 10% and 15%, for example at least 15%, between 15% and 20%, at least 20%, between 20% and 30%, at least 30%, between 30% and 40%, at least 40%, between 40% and 50%, at least 50%, between 50% and 60%, at least 60%, between 60% and 75%, at least 75%, between 75% and 100%, or at least 100%, when compared with uninoculated plants grown under the same conditions. Such increase in overall biomass can be under relatively stress-free conditions. In some embodiments, the increase in biomass can be in plants grown under any number of abiotic or biotic stresses, including drought stress, salt stress, metal stress, heat stress, cold stress, low nutrient stress, nematode stress, insect herbivory stress, fungal pathogen stress, oomycete pathogen stress, bacterial pathogen stress, and viral pathogen stress. In some embodiments, a plurality of endophytes is disposed in an amount effective to increase root biomass by at least 3%, between 3% and 5%, at least 5%, between 5% and 10%, least 10%, between 10% and 15%, for example at least 15%, between 15% and 20%, at least 20%, between 20% and 30%, at least 30%, between 30% and 40%, at least 40%, between 40% and 50%, at least 50%, between 50% and 60%, at least 60%, between 60% and 75%, at least 75%, between 75% and 100%, or at least 100%, when compared with uninoculated plants grown under the same conditions, when compared with a reference agricultural plant.

In some embodiments, a plurality of endophytes is heterologously disposed on the plant element in an amount effective to increase the average biomass of the fruit or cob from the resulting plant at least 3%, between 3% and 5%, at least 5%, between 5% and 10%, least 10%, between 10% and 15%, for example at least 15%, between 15% and 20%, at least 20%, between 20% and 30%, at least 30%, between 30% and 40%, at least 40%, between 40% and 50%, at least 50%, between 50% and 60%, at least 60%, between 60% and 75%, at least 75%, between 75% and 100%, or at least 100%, when compared with uninoculated plants grown under the same conditions.

Increase in plant growth hormones. In some embodiments, microbes described herein are capable of producing the plant hormone auxin indole-3-acetic acid (IAA) when grown in culture. Auxin may play a key role in altering the physiology of the plant, including the extent of root growth. In some embodiments, a plurality of endophytes are heterologously disposed on the surface or within a tissue of the plant element in an amount effective to detectably induce production of auxin in the agricultural plant. For example, the increase in auxin production can be at least 2%, at least 3%, at least 4%, at least 5%, at least 6%, at least 7%, at least 8%, at least 9%, at least 10%, at least 15%, for example, at least 20%, at least 30%, at least 40%, at least 50%, at least 60%, at least 75%, at least 100%, or more, when compared with a reference agricultural plant. In some embodiments, the increased auxin production can be detected in a tissue type selected from the group consisting of the root, shoot, leaves, and flowers.

Improvement of other traits. In some embodiments, a plurality of endophytes can confer other beneficial traits to the plant. Improved traits can include an improved nutritional content of the plant or plant element used for human consumption. In some embodiments, the endophyte-inoculated plant is able to produce a detectable change in the content of at least one nutrient. Examples of such nutrients include amino acid, protein, oil (including any one of Oleic acid, Linoleic acid, Alpha-linoleic acid, Saturated fatty acids, Palmitic acid, Stearic acid and Trans fats), carbohydrate (including sugars such as sucrose, glucose and fructose, starch, or dietary fiber), Vitamin A, Thiamine (vit. B1), Riboflavin (vit. B2), Niacin (vit. B3), Pantothenic acid (B5), Vitamin B6, Folate (vit. B9), Choline, Vitamin C, Vitamin E, Vitamin K, Calcium, Iron, Magnesium, Manganese, Phosphorus, Potassium, Sodium, Zinc. In some embodiments, the endophyte-inoculated plant or part thereof contains at least one increased nutrient when compared with reference agricultural plants.

In some embodiments, the improved trait can include reduced content of a harmful or undesirable substance when compared with reference agricultural plants. Such compounds include those which are harmful when ingested in large quantities or are bitter tasting (for example, oxalic acid, amygdalin, certain alkaloids such as solanine, caffeine, nicotine, quinine and morphine, tannins, cyanide). In some embodiments, the endophyte-inoculated plant or part thereof contains less of the undesirable substance when compared with reference agricultural plant. In some embodiments, the improved trait can include improved taste of the plant or a part of the plant, including the fruit or seed. In some embodiments, the improved trait can include reduction of undesirable compounds produced by other endophytes in plants, such as degradation of *Fusarium*-produced deoxynivalenol (also known as vomitoxin and a virulence factor involved in *Fusarium* head blight of maize and wheat) in a part of the plant, including the fruit or seed.

The endophyte-inoculated plant can also have an altered hormone status or altered levels of hormone production when compared with a reference agricultural plant. An alteration in hormonal status may affect many physiological parameters, including flowering time, water efficiency, apical dominance and/or lateral shoot branching, increase in root hair, and alteration in fruit ripening.

The synthetic combination between the endophytes and the plant can also be detected using other methods known in the art. For example, the biochemical, genomic, epigenomic, transcriptomic, metabolomics, and/or proteomic profiles of endophyte-inoculated plants can be compared with reference isoline agricultural plants under the same conditions.

Transcriptome analysis of endophyte-inoculated and reference agricultural plants can also be performed to detect changes in expression of at least one transcript, or a set or network of genes upon endophyte association. Similarly, epigenetic changes can be detected using methylated DNA immunoprecipitation followed by high-throughput sequencing or targeted or whole genome bisulfate sequencing.

Metabolomic or proteomic differences between the plants can be detected using methods known in the art. The metabolites, proteins, or other compounds described herein can be detected using any suitable method including, but not limited to gel electrophoresis, liquid and gas phase chromatography, either alone or coupled to mass spectrometry, NMR, immunoassays (enzyme-linked immunosorbent assays (ELISA)), chemical assays, spectroscopy and the like. In some embodiments, commercial systems for chromatography and NMR analysis are utilized. Such metabolomic methods can be used to detect differences in levels in hormone, nutrients, secondary metabolites, root exudates, phloem sap content, xylem sap content, heavy metal content, and the like. Such methods are also useful for detecting alterations in endophyte content and status; for example, the presence and levels of signaling molecules (e.g., autoinducers and pheromones), which can indicate the status of group-based behavior of endophytes based on, for example, population density. In some embodiments, a biological sample (whole tissue, exudate, phloem sap, xylem sap, root exudate, etc.) from endophyte-inoculated and reference agricultural plants can be analyzed essentially as known in the art.

In some embodiments, metabolites in plants can be modulated by making synthetic combinations of pluralities of endophytes heterologously disposed onto said plant. For example, a plurality of endophytes can cause a detectable modulation (e.g., an increase or decrease) in the level of various metabolites, e.g., indole-3-carboxylic acid, trans-zeatin, abscisic acid, phaseic acid, indole-3-acetic acid, indole-3-butyric acid, indole-3-acrylic acid, jasmonic acid, jasmonic acid methyl ester, dihydrophaseic acid, gibberellin A3, salicylic acid, upon colonization of a plant.

In some embodiments, a plurality of endophytes modulates the level of the metabolite directly (e.g., the microbes produces the metabolite, resulting in an overall increase in the level of the metabolite found in the plant). In other cases, the agricultural plant, as a result of the association with the plurality of endophytes, exhibits a modulated level of the metabolite (e.g., the plant reduces the expression of a biosynthetic enzyme responsible for production of the metabolite as a result of the microbe inoculation). In some embodiments, the modulation in the level of the metabolite is a consequence of the activity of both the microbe and the plant (e.g., the plant produces increased amounts of the metabolite when compared with a reference agricultural plant, and the endophyte also produces the metabolite). Therefore, as used herein, a modulation in the level of a metabolite can be an alteration in the metabolite level through the actions of the microbe and/or the inoculated plant.

The levels of a metabolite can be measured in an agricultural plant, and compared with the levels of the metabolite in a reference agricultural plant, and grown under the same conditions as the inoculated plant. The uninoculated plant that is used as a reference agricultural plant is a plant that has not been applied with a formulation with the plurality of endophytes (e.g., a formulation comprising a plurality of populations of purified endophytes). The uninoculated plant used as the reference agricultural plant is generally the same species and cultivar as, and is isogenic to, the inoculated plant.

The metabolite whose levels are modulated (e.g., increased or decreased) in the endophyte-inoculated plant may serve as a primary nutrient (i.e., it provides nutrition for the humans and/or animals who consume the plant, plant tissue, or the commodity plant product derived therefrom, including, but not limited to, a sugar, a starch, a carbohydrate, a protein, an oil, a fatty acid, or a vitamin). The metabolite can be a compound that is important for plant growth, development or homeostasis (for example, a phytohormone such as an auxin, cytokinin, gibberellin, a brassinosteroid, ethylene, or abscisic acid, a signaling molecule, or an antioxidant). In other embodiments, the metabolite can have other functions. For example, in some embodiments, a metabolite can have bacteriostatic, bactericidal, fungistatic, fungicidal or antiviral properties. In other embodiments, the metabolite can have insect-repelling, insecticidal, nematode-repelling, or nematicidal properties. In still other embodiments, the metabolite can serve a role in protecting the plant from stresses, may help improve plant vigor or the general health of the plant. In yet another embodiment, the metabolite can be a useful compound for industrial production. For example, the metabolite may itself be a useful compound that is extracted for industrial use, or serve as an intermediate for the synthesis of other compounds used in industry. In a particular embodiment, the level of the metabolite is increased within the agricultural plant or a portion thereof such that it is present at a concentration of at least 0.1 ug/g dry weight, for example, at least 0.3 ug/g dry weight, between 0.3 ug/g and 1.0 ug/g dry weight, at least 1.0 ug/g dry weight, between 1.0 ug/g and 3.0 ug/g dry weight, at least 3.0 ug/g dry weight, between 3.0 ug/g and 10 ug/g dry weight, at least 10 ug/g dry weight, between 10 ug/g and 30 ug/g dry weight, at least 30 ug/g dry weight, between 30 ug/g and 100 ug/g dry weight, at least 100 ug/g dry weight, between 100 ug/g and 300 ug/g dry weight, at least 300 ug/g dry weight, between 300 ug/g and 1 mg/g dry weight, or more than 1 mg/g dry weight, of the plant or portion thereof.

Likewise, the modulation can be a decrease in the level of a metabolite. The reduction can be in a metabolite affecting the taste of a plant or a commodity plant product derived from a plant (for example, a bitter tasting compound), or in a metabolite which makes a plant or the resulting commodity plant product otherwise less valuable (for example, reduction of oxalate content in certain plants, or compounds which are deleterious to human and/or animal health). The metabolite whose level is to be reduced can be a compound that affects quality of a commodity plant product (e.g., reduction of lignin levels).

Formulations for Agricultural Use

The present invention contemplates a synthetic combination comprising a plant element and a plurality of heterologously disposed endophytes in an effective amount to confer an improved trait of agronomic importance to the host plant, or an improved agronomic trait potential to a plant element associated with the endophytes, that upon and after germination will confer said benefit to the resultant host plant.

In some embodiments, the plant element is associated with a plurality of endophytes on its surface. Such association is contemplated to be via a mechanism selected from the group consisting of: spraying, immersion, coating, encapsulating, dusting, dripping, aerosolizing, seed treatment, root wash, seedling soak, foliar application, soil inocula, in-furrow application, sidedress application, soil pre-treatment, wound inoculation, drip tape irrigation, vector-mediation via a pollinator, injection, osmopriming, hydroponics, aquaponics, and aeroponics.

In some embodiments, the plant element is a leaf, and the synthetic combination is formulated for application as a foliar treatment.

In some embodiments, the plant element is a seed, and the synthetic combination is formulated for application as a seed coating.

In some embodiments, the plant element is a root, and the synthetic combination is formulated for application as a root treatment.

In certain embodiments, the plant element is manually, mechanically, or artificially inoculated with a plurality of endophytes through delayed exposure. For example, the soil in which a plant element is to be introduced is first treated with a composition comprising a plurality of endophytes. In another example, the area around the plant or plant element is treated with a formulation comprising a plurality of endophytes within a matrix which temporarily segregates the plurality of endophytes from the plant or plant element; the plant or plant element is subsequently contacted with the endophytes due to removal of the matrix by movement of soil, air, water, insects, mammals, human intervention, or other methods.

The plant element can be obtained from any agricultural plant. In some embodiments, the plant element of the first plant is from a monocotyledonous plant. For example, the plant element of the first plant is from a cereal plant. The plant element of the first plant can be selected from the group consisting of a maize seed, a wheat seed, a barley seed, a rice seed, a sugarcane seed, a maize root, a wheat root, a barley root, a sugarcane root, a rice root, a maize leaf, a wheat leaf, a barley leaf, a sugarcane leaf, or a rice leaf. In an alternative embodiment, the plant element of the first plant is from a dicotyledonous plant. The plant element of the first plant can be selected from the group consisting of a cotton seed, a tomato seed, a canola seed, a pepper seed, a soybean seed, a cotton root, a tomato root, a canola root, a pepper root, a soybean root, a cotton leaf, a tomato leaf, a canola leaf, a pepper leaf, or a soybean leaf. In still another embodiment, the plant element of the first plant can be from a genetically modified plant. In other embodiments, the plant element of the first plant can be a hybrid plant element.

The synthetic combination can comprise a plant element of the first plant which is surface-sterilized prior to combining with a plurality of endophytes. Such pre-treatment prior to coating the seed with endophytes removes the presence of other microbes which may interfere with the optimal colonization, growth and/or function of the endophytes. Surface sterilization of seeds can be accomplished without killing the seeds as described herein.

A plurality of endophytes is intended to be useful in the improvement of agricultural plants, and as such, may be formulated with other compositions as part of an agriculturally compatible carrier. It is contemplated that such carriers can include, but not be limited to: seed treatment, root treatment, foliar treatment, and soil treatment. The carrier composition with a plurality of endophytes, may be prepared for agricultural application as a liquid, a solid, or a gas formulation. Application to the plant may be achieved, for example, as a powder for surface deposition onto plant leaves, as a spray to the whole plant or selected plant element, as part of a drip to the soil or the roots, or as a coating onto the seed prior to planting. Such examples are meant to be illustrative and not limiting to the scope of the invention.

In some embodiments, the present invention contemplates plant elements comprising a plurality of endophytes, and further comprising a formulation. The formulation useful for these embodiments generally comprises at least one member selected from the group consisting of an agriculturally compatible carrier, a tackifier, a microbial stabilizer, a fungicide, an antibacterial agent, an herbicide, a nematicide, an insecticide, a plant growth regulator, a rodenticide, and a nutrient.

In some cases, a plurality of endophytes is mixed with an agriculturally compatible carrier. The carrier can be a solid carrier or liquid carrier. The carrier may be any one or more of a number of carriers that confer a variety of properties, such as increased stability, wettability, or dispersability. Wetting agents such as natural or synthetic surfactants, which can be nonionic or ionic surfactants, or a combination thereof can be included in a composition of the invention. Water-in-oil emulsions can also be used to formulate a composition that includes a plurality of endophytes. Suitable formulations that may be prepared include wettable powders, granules, gels, agar strips or pellets, thickeners, and the like, microencapsulated particles, and the like, liquids such as aqueous flowables, aqueous suspensions, water-in-oil emulsions, etc. The formulation may include grain or legume products, for example, ground grain or beans, broth or flour derived from grain or beans, starch, sugar, or oil.

In some embodiments, the agricultural carrier may be soil or plant growth medium. Other agricultural carriers that may be used include fertilizers, plant-based oils, humectants, or combinations thereof. Alternatively, the agricultural carrier may be a solid, such as diatomaceous earth, loam, silica, alginate, clay, bentonite, vermiculite, seed cases, other plant and animal products, or combinations, including granules, pellets, or suspensions. Mixtures of any of the aforementioned ingredients are also contemplated as carriers, such as but not limited to, pesta (flour and kaolin clay), agar or flour-based pellets in loam, sand, or clay, etc. Formulations may include food sources for the cultured organisms, such as barley, rice, or other biological materials such as seed, leaf, root, plant elements, sugar cane bagasse, hulls or stalks from grain processing, ground plant material or wood from building site refuse, sawdust or small fibers from recycling of paper, fabric, or wood. Other suitable formulations will be known to those skilled in the art.

In some embodiments, the formulation can comprise a tackifier or adherent. Such agents are useful for combining the microbial population of the invention with carriers that can contain other compounds (e.g., control agents that are not biologic), to yield a coating composition. Such compositions help create coatings around the plant or plant element to maintain contact between the microbe and other agents with the plant or plant part. In some embodiments, adherents are selected from the group consisting of: alginate, gums, starches, lecithins, formononetin, polyvinyl alcohol, alkali formononetinate, hesperetin, polyvinyl acetate, cephalins, Gum Arabic, Xanthan Gum, carragennan, PGA, other biopolymers, Mineral Oil, Polyethylene Glycol (PEG), Polyvinyl pyrrolidone (PVP), Arabino-galactan, Methyl Cellulose, PEG 400, Chitosan, Polyacrylamide, Polyacrylate, Polyacrylonitrile, Glycerol, Triethylene glycol, Vinyl Acetate, Gellan Gum, Polystyrene, Polyvinyl, Carboxymethyl cellulose, Gum Ghatti, and polyoxyethylene-polyoxybutylene block copolymers. Other examples of adherent compositions that can be used in the synthetic preparation include those described in EP 0818135, CA 1229497, WO 2013090628, EP 0192342, WO 2008103422 and CA 1041788, each of which is incorporated herein by reference in its entirety.

It is also contemplated that the formulation may further comprise an anti-caking agent.

The formulation can also contain a surfactant, wetting agent, emulsifier, stabilizer, or anti-foaming agent. Non-limiting examples of surfactants include nitrogen-surfactant blends such as Prefer 28 (Cenex), Surf-N(US), Inhance (Brandt), P-28 (Wilfarm) and Patrol (Helena); esterified seed oils include Sun-It II (AmCy), MSO (UAP), Scoil (Agsco), Hasten (Wilfarm) and Mes-100 (Drexel); and organo-silicone surfactants include Silwet L77 (UAP), Silikin (Terra), Dyne-Amic (Helena), Kinetic (Helena), Sylgard 309 (Wilbur-Ellis) and Century (Precision), polysorbate 20, polysorbate 80, Tween 20, Tween 80, Scattics, Alktest TW20, Canarcel, Peogabsorb 80, Triton X-100, Conco NI, Dowfax 9N, Igebapl CO, Makon, Neutronyx 600, Nonipol NO, Plytergent B, Renex 600, Solar NO, Sterox, Serfonic N, T-DET-N, Tergitol NP, Triton N, IGEPAL CA-630, Nonident P-40, and Pluronic. In some embodiments, the surfactant is present at a concentration of between 0.01% v/v to 10% v/v. In other embodiments, the surfactant is present at a concentration of between 0.1% v/v to 1% v/v. An example of an anti-foaming agent is Antifoam-C.

In certain cases, the formulation includes a microbial stabilizer. Such an agent can include a desiccant. As used herein, a "desiccant" can include any compound or mixture of compounds that can be classified as a desiccant regardless of whether the compound or compounds are used in such concentrations that they in fact have a desiccating effect on the liquid inoculant. Such desiccants are ideally compatible with the endophytes used, and should promote the ability of the microbial population to survive application on the plant elements and to survive desiccation. Examples of suitable desiccants include one or more of trehalose, sucrose, glycerol, and Methylene glycol. Other suitable desiccants include, but are not limited to, non-reducing sugars and sugar alcohols (e.g., mannitol or sorbitol). The amount of desiccant introduced into the formulation can range from about 5% to about 50% by weight/volume, for example, between about 10% to about 40%, between about 15% and about 35%, or between about 20% and about 30%.

In some cases, it is advantageous for the formulation to contain agents such as a fungicide, an antibacterial agent, an herbicide, a nematicide, an insecticide, a plant growth regulator, a rodenticide, a bactericide, a virucide, and a nutrient. Such agents are ideally compatible with the agricultural plant element or seedling onto which the formulation is applied (e.g., it should not be deleterious to the growth or health of the plant). Furthermore, the agent is ideally one which does not cause safety concerns for human, animal or industrial use (e.g., no safety issues, or the compound is sufficiently labile that the commodity plant product derived from the plant contains negligible amounts of the compound).

In the liquid form, for example, solutions or suspensions, a plurality of endophytes can be mixed or suspended in aqueous solutions. Suitable liquid diluents or carriers include aqueous solutions, petroleum distillates, or other liquid carriers.

Solid compositions can be prepared by dispersing a plurality of endophytes of the invention in and on an appropriately divided solid carrier, such as peat, wheat, bran, vermiculite, clay, talc, bentonite, diatomaceous earth, fuller's earth, pasteurized soil, and the like. When such formulations are used as wettable powders, biologically compatible dispersing agents such as non-ionic, anionic, amphoteric, or cationic dispersing and emulsifying agents can be used.

The solid carriers used upon formulation include, for example, mineral carriers such as kaolin clay, pyrophyllite, bentonite, montmorillonite, diatomaceous earth, acid white soil, vermiculite, and pearlite, and inorganic salts such as ammonium sulfate, ammonium phosphate, ammonium nitrate, urea, ammonium chloride, and calcium carbonate. Also, organic fine powders such as wheat flour, wheat bran, and rice bran may be used. The liquid carriers include vegetable oils such as soybean oil and cottonseed oil, glycerol, ethylene glycol, polyethylene glycol, propylene glycol, polypropylene glycol, etc.

In some embodiments, the formulation is ideally suited for coating of a plurality of endophytes onto plant elements. The plurality of endophytes is capable of conferring many agronomic benefits to the host plants. The ability to confer such benefits by coating the plurality of endophytes on the surface of plant elements has many potential advantages, particularly when used in a commercial (agricultural) scale.

A plurality of endophytes can be combined with one or more of the agents described above to yield a formulation suitable for combining with an agricultural plant element or seedling. The plurality of endophytes can be obtained from growth in culture, for example, using a synthetic growth medium. In addition, the microbe can be cultured on solid media, for example on petri dishes, scraped off and suspended into the preparation. Microbes at different growth phases can be used. For example, microbes at lag phase, early-log phase, mid-log phase, late-log phase, stationary phase, early death phase, or death phase can be used. Endophytic spores may be used for the present invention, for example but not limited to: arthospores, sporangispores, conidia, chlamadospores, pycnidiospores, endospores, zoospores.

The formulations comprising a plurality of endophytes of the present invention typically contains between about 0.1 to 95% by weight, for example, between about 1% and 90%, between about 3% and 75%, between about 5% and 60%, between about 10% and 50% in wet weight of a plurality of endophytes. In some embodiments, the formulation contains at least about $10^2$ per ml of formulation, at least about $10^3$ per ml of formulation, for example, at least about $10^4$, at least about $10^5$, at least about $10^6$, at least about $10^7$ CFU or spores, at least about $10^8$ CFU or spores per ml of formulation. In some embodiments, the formulation be applied to the plant element at about $10^2$ CFU/seed, between $10^2$ and $10^3$ CFU, at least about $10^3$ CFU, between $10^3$ and $10^4$ CFU, at least about $10^4$ CFU, between $10^4$ and $10^5$ CFU, at least about $10^5$ CFU, between $10^5$ and $10^6$ CFU, at least about $10^6$ CFU, between $10^6$ and $10^7$ CFU, at least about $10^7$ CFU, between $10^7$ and $10^8$ CFU, or even greater than $10^8$ CFU per seed.

The compositions provided herein are preferably stable. The endophyte may be shelf-stable, where at least 0.01%, of the CFU or spores are viable after storage in desiccated form (i.e., moisture content of 30% or less) for 1, 2, 3, 4, 5, 6, 7, 8, 9, 10 or greater than 10 weeks at 4° C. or at room temperature. Optionally, a shelf-stable formulation is in a dry formulation, a powder formulation, or a lyophilized formulation. In some embodiments, the formulation is formulated to provide stability for the population of endophytes. In one embodiment, the formulation is substantially stable at temperatures between about −20° C. and about 50° C. for at least about 1, 2, 3, 4, 5, or 6 days, or 1, 2, 3 or 4 weeks, or 1, 2, 3, 4, 5, 6, 7, 8, 9, 10, 11 or 12 months, or one or more years. In another embodiment, the formulation is substantially stable at temperatures between about 4° C. and about 37° C. for at least about 5, 10, 15, 20, 25, 30 or greater than 30 days.

As described above, in certain embodiments, the present invention contemplates the use of a plurality of endophytes heterologously disposed on the plant, for example, the plant element. In certain cases, the agricultural plant may contain bacteria that are substantially similar to, or even genetically indistinguishable from, the bacteria that are being applied to the plant. It is noted that, in many cases, the bacteria that are being applied markedly different from the bacteria already present in several significant ways. First, the bacteria that are being applied to the agricultural plant have been adapted to culture, or adapted to be able to grow on growth media in isolation from the plant. Second, in many cases, the bacteria that are being applied are derived from a clonal origin, rather than from a heterologous origin and, as such, can be distinguished from the bacteria that are already present in the agricultural plant by the clonal similarity. For example, where a microbe that has been inoculated by a plant is also present in the plant (for example, in a different tissue or portion of the plant), or where the introduced microbe is sufficiently similar to a microbe that is present in some of the plants (or portion of the plant, including plant elements), it is still possible to distinguish between the inoculated microbe and the native microbe by distinguishing between the two microbe types on the basis of their epigenetic status (e.g., the bacteria that are applied, as well as their progeny, would be expected to have a much more uniform and similar pattern of cytosine methylation of its genome, with respect to the extent and/or location of methylation).

Endophytes Compatible with Agrichemicals

In certain embodiments, the plurality of endophytes is selected on the basis of its compatibility with commonly used agrichemicals. As described herein, plants, particularly agricultural plants, can be treated with a vast array of agrichemicals, including fungicides, biocides (anti-complex agents), herbicides, insecticides, nematicides, rodenticides, fertilizers, and other agents.

In some cases, it can be important for the plurality of endophytes to be compatible with agrichemicals, particularly those with anticomplex properties, in order to persist in the plant although, as mentioned earlier, there are many such anticomplex agents that do not penetrate the plant, at least at a concentration sufficient to interfere with the endophytes. Therefore, where a systemic anticomplex agent is used in the plant, compatibility of the endophytes to be inoculated with such agents will be an important criterion.

Fungicides. The fungicide can be a protectant predominantly on the seed surface, providing protection against seed surface-borne pathogens and providing some level of control of soil-borne pathogens. Non-limiting examples of protectant fungicides include captan, maneb, thiram, or fludioxonil. The fungicide can be a systemic fungicide, which can be absorbed into the emerging seedling and inhibit or kill the fungus inside host plant tissues. Systemic fungicides used for seed treatment include, but are not limited to the following: azoxystrobin, carboxin, mefenoxam, metalaxyl, thiabendazole, trifloxystrobin, and various triazole fungicides, including difenoconazole, ipconazole, tebuconazole, and triticonazole. Mefenoxam and metalaxyl are primarily used to target the water mold fungi *Pythium* and *Phytophthora*. Some fungicides are preferred over others, depending on the plant species, either because of subtle differences in sensitivity of the pathogenic fungal species, or because of the differences in the fungicide distribution or sensitivity of the plants.

A fungicide can be a biological control agent, such as a bacterium or fungus. Such organisms may be parasitic to the pathogenic fungi, or secrete toxins or other substances which can kill or otherwise prevent the growth of fungi. Any type of fungicide, particularly ones that are commonly used on plants, can be used as a control agent in a seed composition.

Antibacterial agents. In some cases, the seed coating composition comprises a control agent which has antibacterial properties. In some embodiments, the control agent with antibacterial properties is selected from the compounds described herein elsewhere. In other embodiments, the compound is Streptomycin, oxytetracycline, oxolinic acid, or gentamicin.

Plant growth regulators. The seed coat composition can further comprise a plant growth regulator. In some embodiments, the plant growth regulator is selected from the group consisting of: Abscisic acid, amidochlor, ancymidol, 6-benzylaminopurine, brassinolide, butralin, chlormequat (chlormequat chloride), choline chloride, cyclanilide, daminozide, dikegulac, dimethipin, 2,6-dimethylpuridine, ethephon, flumetralin, flurprimidol, fluthiacet, forchlorfenuron, gibberellic acid, inabenfide, indole-3-acetic acid, maleic hydrazide, mefluidide, mepiquat (mepiquat chloride), naphthaleneacetic acid, N-6-benzyladenine, paclobutrazol, prohexadione (prohexadione-calcium), prohydrojasmon, thidiazuron, triapenthenol, tributyl phosphorotrithioate, 2,3,5-tri-iodobenzoic acid, trinexapac-ethyl and uniconazole. Other examples of antibacterial compounds which can be used as part of a seed coating composition include those based on dichlorophene and benzylalcohol hemi formal (Proxel® from ICI or Acticide® RS from Thor Chemie and Kathon® MK from Rohm & Haas) and isothiazolinone derivatives such as alkylisothiazolinones and benzisothiazolinones (Acticide® MBS from Thor Chemie). Other plant growth regulators that can be incorporated seed coating compositions are described in US 2012/0108431, which is incorporated by reference in its entirety.

Nematicides. Preferred nematode-antagonistic biocontrol agents include ARF18; *Arthrobotrys* spp.; *Chaetomium* spp.; *Cylindrocarpon* spp.; *Exophilia* spp.; *Fusarium* spp.; *Gliocladium* spp.; *Hirsutella* spp.; *Lecanicillium* spp.; *Monacrosporium* spp.; *Myrothecium* spp.; *Neocosmospora* spp.; *Paecilomyces* spp.; *Pochonia* spp.; *Stagonospora* spp.; vesicular-arbuscular mycorrhizal fungi, *Burkholderia* spp.; *Pasteuria* spp., *Brevibacillus* spp.; *Pseudomonas* spp.; and Rhizobacteria. Particularly preferred nematode-antagonistic biocontrol agents include ARF18, *Arthrobotrys oligospora, Arthrobotrys dactyloides, Chaetomium globosum, Cylindrocarpon heteronema, Exophilia jeanselmei, Exophilia pisciphila, Fusarium aspergilus, Fusarium solani, Gliocladium catenulatum, Gliocladium roseum, Gliocladium* vixens, *Hirsutella rhossiliensis, Hirsutella minnesotensis, Lecanicillium lecanii, Monacrosporium drechsleri, Monacrosporium gephyropagum, Myrothecium verrucaria, Neocosmospora vasinfecta, Paecilomyces lilacinus, Pochonia chlamydosporia, Stagonospora heteroderae, Stagonospora phaseoli,* vesicular-arbuscular mycorrhizal fungi, *Burkholderia cepacia, Pasteuria penetrans, Pasteuria thornei, Pasteuria nishizawae, Pasteuria ramosa, Pastrueia usage, Brevibacillus laterosporus* strain G4, *Pseudomonas fluorescens* and Rhizobacteria.

Nutrients. In other embodiments, the seed coating composition can comprise a nutrient. The nutrient can be selected from the group consisting of a nitrogen fertilizer including, but not limited to Urea, Ammonium nitrate, Ammonium sulfate, Non-pressure nitrogen solutions, Aqua ammonia, Anhydrous ammonia, Ammonium thiosulfate, Sulfur-coated urea, Urea-formaldehydes, IBDU, Polymer-coated urea, Calcium nitrate, Ureaform, and Methylene urea, phosphorous fertilizers such as Diammonium phosphate, Monoammonium phosphate, Ammonium polyphosphate, Concentrated superphosphate and Triple superphosphate, and potassium fertilizers such as Potassium chloride, Potassium sulfate, Potassium-magnesium sulfate, Potassium nitrate. Such compositions can exist as free salts or ions within the seed coat composition. Alternatively, nutrients/fertilizers can be complexed or chelated to provide sustained release over time.

Rodenticides. Rodents such as mice and rats cause considerable economical damage by eating and soiling planted or stored seeds. Moreover, mice and rats transmit a large number of infectious diseases such as plague, typhoid, leptospirosis, trichinosis and salmonellosis. Anticoagulants such as coumarin and indandione derivatives play an important role in the control of rodents. These active ingredients are simple to handle, relatively harmless to humans and have the advantage that, as the result of the delayed onset of the activity, the animals being controlled identify no connection with the bait that they have ingested, therefore do not avoid it. This is an important aspect in particular in social animals such as rats, where individuals act as tasters. In some embodiments, the seed coating composition comprises a rodenticide selected from the group of substances consisting of 2-isovalerylindan-1,3-dione, 4-(quinoxalin-2-ylamino)benzenesulfonamide, alpha-chlorohydrin, aluminum phosphide, antu, arsenous oxide, barium carbonate, bisthiosemi, brodifacoum, bromadiolone, bromethalin, calcium cyanide, chloralose, chlorphacinone, cholecalciferol, coumachlor, coumafuryl, coumatetralyl, crimidine, difenacoum, difethialone, diphacinone, ergocalciferol, flocoumafen, fluoroacetamide, flupropadine, flupropadine hydrochloride, hydrogen cyanide, iodomethane, lindane, magnesium phosphide, methyl bromide, norbormide, phosacetim, phosphine, phosphorus, pindone, potassium arsenite, pyrinuron, scilliroside, sodium arsenite, sodium cyanide, sodium fluoroacetate, strychnine, thallium sulfate, warfarin and zinc phosphide.

Compatibility

In some embodiments, a plurality of endophytes that are compatible with agrichemicals can be used to inoculate the plants according to the methods described herein. In each case below, each type of endophyte used in a plurality of endophytes can be tested for compatibility on their own or as the plurality. Endophytes that are compatible with agriculturally employed anticomplex agents can be isolated by plating a culture of endophytes on a petri dish comprising an effective concentration of the anticomplex agent, and isolating colonies of endophytes that are compatible with the anticomplex agent. In other embodiments, a plurality of endophytes that are compatible with an anticomplex agent are used for the methods described herein.

In some embodiments, the endophytes of the present invention display tolerance to an agrichemical selected from the group consisting of: Aeris®, Avicta® DuoCot 202, Cruiser®, Syntenta CCB® (A), Clariva®, Albaugh, Dynasty®, Apron®, Maxim®, Gaucho®, Provoke® ST, Syngenta CCB®, Trilex®, WG Purple, WG Silver, Azoxystrobin, Carboxin, Difenoconazole, Fludioxonil, fluxapyroxad, Ipconazole, Mefenoxam, Metalaxyl, Myclobutanil, Penflufen, pyraclostrobin, Sedaxane, TCMTB, Tebuconazole, Thiram, Triadimenol (Baytan®), Trifloxystrobin, Triticonazole, Tolclofos-methyl, PCNB, Abamectin, Chlorpyrifos, Clothianidin, Imidacloprid, Thiamethoxam, and Thiodicarb.

Bactericide-compatible endophytes can also be isolated by selection on liquid medium. The culture of endophytes can be plated on petri dishes without any forms of mutagenesis; alternatively, endophytes can be mutagenized using any means known in the art. For example, endophyte cultures can be exposed to UV light, gamma-irradiation, or chemical mutagens such as ethylmethanesulfonate (EMS), ethidium bromide (EtBr) dichlovos (DDVP, methyl methane sulphonale (MMS), triethylphosphate (TEP), trimethylphosphate (TMP), nitrous acid, or DNA base analogs, prior to selection on fungicide comprising media. Finally, where the mechanism of action of a particular bactericide is known, the target gene can be specifically mutated (either by gene deletion, gene replacement, site-directed mutagenesis, etc.) to generate a plurality of endophytes that are resilient against that particular chemical. It is noted that the above-described methods can be used to isolate endophytes that are compatible with both bacteriostatic and bactericidal compounds.

It will also be appreciated by one skilled in the art that a plant may be exposed to multiple types of anticomplex compounds, either simultaneously or in succession, for example at different stages of plant growth. Where the target plant is likely to be exposed to multiple anticomplex agents, a plurality of endophytes that are compatible with many or all of these agrichemicals can be used to inoculate the plant. Endophytes that are compatible with several agents can be isolated, for example, by serial selection. Endophytes that are compatible with the first agent can be isolated as described above (with or without prior mutagenesis). A culture of the resulting endophytes can then be selected for the ability to grow on liquid or solid media comprising the second agent (again, with or without prior mutagenesis). Colonies isolated from the second selection are then tested to confirm its compatibility to both agents.

Likewise, endophytes that are compatible to biocides (including herbicides such as glyphosate or anticomplex compounds, whether bacteriostatic or bactericidal) that are agriculturally employed can be isolated using methods similar to those described for isolating compatible endophytes. In some embodiments, mutagenesis of the endophytes can be performed prior to selection with an anticomplex agent. In other embodiments, selection is performed on the endophytes without prior mutagenesis. In still another embodiment, serial selection is performed on endophytes: the endophytes are first selected for compatibility to a first anticomplex agent. The isolated compatible endophytes are then cultured and selected for compatibility to the second anticomplex agent. Any colony thus isolated is tested for compatibility to each, or both anticomplex agents to confirm compatibility with these two agents.

Compatibility with an antimicrobial agent can be determined by a number of means known in the art, including the comparison of the minimal inhibitory concentration of the unmodified and modified endophytes. Therefore, in some embodiments, the present invention discloses modified endophytes, wherein the endophytes are modified such that they exhibit at least 3 fold greater, for example, at least 5 fold greater, between 5 and 10 fold greater, at least 10 fold greater, between 10 and 20 fold greater, at least 20 fold greater, between 20 and 30 fold greater, at least 30 fold greater or more minimal inhibitory concentration to an antimicrobial agent when compared with the unmodified endophytes.

In some embodiments, disclosed herein are endophytes with enhanced compatibility to the herbicide glyphosate. In some embodiments, the endophytes have a doubling time in growth medium comprising least 1 mM glyphosate, for example, between 1 mM and 2 mM glyphosate, at least 2 mM glyphosate, between 2 mM and 5 mM glyphosate, at least 5 mM glyphosate, between 5 mM and 10 mM glyphosate, at least 10 mM glyphosate, between 10 mM and 15 mM glyphosate, at least 15 mM glyphosate or more, that is no more than 250%, between 250% and 100%, for example, no more than 200%, between 200% and 175%, no more than 175%, between 175% and 150%, no more than 150%, between 150% and 125%, or no more than 125%, of the doubling time of the endophytes in the same growth medium comprising no glyphosate. In some embodiments, the endophytes have a doubling time in growth medium comprising 5 mM glyphosate that is no more than 150% the doubling time of the endophytes in the same growth medium comprising no glyphosate.

In other embodiments, the endophytes have a doubling time in a plant tissue comprising at least 10 ppm glyphosate, for example, between 10 and 15 ppm, at least 15 ppm glyphosate, between 15 and 10 ppm, at least 20 ppm glyphosate, between 20 and 30 ppm, at least 30 ppm glyphosate, between 30 and 40 ppm, at least 40 ppm glyphosate or more, that is no more than 250%, between 250% and 200%, for example, no more than 200%, between 200% and 175%, no more than 175%, between 175% and 150%, no more than 150%, between 150% and 125%, of the doubling time of the endophytes in a reference plant tissue comprising no glyphosate. In some embodiments, the endophytes have a doubling time in a plant tissue comprising 40 ppm glyphosate that is no more than 150% the doubling time of the endophytes in a reference plant tissue comprising no glyphosate.

The selection process described above can be repeated to identify isolates of endophytes that are compatible with a multitude of agents.

Candidate isolates can be tested to ensure that the selection for agrichemical compatibility did not result in loss of a desired bioactivity. Isolates of endophytes that are compatible with commonly employed agents can be selected as described above. The resulting compatible endophytes can be compared with the parental endophytes on plants in its ability to promote germination.

The agrichemical compatible endophytes generated as described above can be detected in samples. For example, where a transgene was introduced to render the endophytes compatible with the agrichemical(s), the transgene can be used as a target gene for amplification and detection by PCR. In addition, where point mutations or deletions to a portion of a specific gene or a number of genes results in compatibility with the agrichemical(s), the unique point mutations can likewise be detected by PCR or other means known in the art. Such methods allow the detection of the endophytes even if they are no longer viable. Thus, commodity plant products produced using the agrichemical compatible endophytes described herein can readily be identified by employing these and related methods of nucleic acid detection.

Populations of Plant Elements

The synthetic combinations of the present invention may be confined within an object selected from the group consisting of: bottle, jar, ampule, package, vessel, bag, box, bin, envelope, carton, container, silo, shipping container, truck bed, and case. In a particular embodiment, the population of plant elements is packaged in a bag or container suitable for commercial sale. For example, a bag contains a unit weight or count of the plant elements comprising a plurality of endophytes as described herein, and further comprises a label. In one embodiment, the bag or container contains at least 100 plant elements, between 100 and 1,000 plant elements, 1,000 plant elements, between 1,000 and 5,000 plant elements, for example, at least 5,000 plant elements, between 5,000 and 10,000 plant elements, at least 10,000 plant elements, between 10,000 and 20,000 plant elements, at least 20,000 plant elements, between 20,000 and 30,000 plant elements, at least 30,000 plant elements, between 30,000 and 50,000 plant elements, at least 50,000 plant elements, between 50,000 and 70,000 plant elements, at least 70,000 plant elements, between 70,000 and 80,000 plant elements, at least 80,000 plant elements, between 80,000 and 90,000, at least 90,000 plant elements or more. In another embodiment, the bag or container can comprise a discrete weight of plant elements, for example, at least 1 lb, between 1 and 2 lbs, at least 2 lbs, between 2 and 5 lbs, at least 5 lbs, between 5 and 10 lbs, at least 10 lbs, between 10 and 30 lbs, at least 30 lbs, between 30 and 50 lbs, at least 50 lbs, between 50 and 70 lmbs, at least 70 lbs or more. The label can contain additional information, for example, the information selected from the group consisting of: net weight, lot number, geographic origin of the plant elements, test date, germination rate, inert matter content, and the amount of noxious weeds, if any. Suitable containers or packages include those traditionally used in plant or plant element commercialization. The invention also contemplates other containers with more sophisticated storage capabilities (e.g., with microbiologically tight wrappings or with gas- or water-proof containments).

In some cases, a sub-population of plant elements comprising a plurality of endophytes is further selected on the basis of increased uniformity, for example, on the basis of uniformity of microbial population. For example, individual plant elements of pools collected from individual cobs, individual plants, individual plots (representing plants inoculated on the same day) or individual fields can be tested for uniformity of microbial density, and only those pools meeting specifications (e.g., at least 80% of tested plant elements have minimum density, as determined by quantitative methods described elsewhere) are combined to provide the agricultural plant element sub-population.

The methods described herein can also comprise a validating step. The validating step can entail, for example, growing some plant elements collected from the inoculated plants into mature agricultural plants, and testing those individual plants for uniformity. Such validating step can be performed on individual plant elements collected from cobs, individual plants, individual plots (representing plants inoculated on the same day) or individual fields, and tested as described above to identify pools meeting the required specifications.

In some embodiments, methods described herein include planting a synthetic combination described herein. Suitable planters include an air seeder and/or fertilizer apparatus used in agricultural operations to apply particulate materials including one or more of the following, seed, fertilizer and/or inoculants, into soil during the planting operation. Seeder/fertilizer devices can include a tool bar having ground-engaging openers thereon, behind which is towed a wheeled cart that includes one or more containment tanks or bins and associated metering means to respectively contain and meter therefrom particulate materials.

In certain embodiments, a composition described herein may be in the form of a liquid, a slurry, a solid, or a powder (wettable powder or dry powder). In another embodiment, a composition may be in the form of a seed coating. Compositions in liquid, slurry, or powder (e.g., wettable powder) form may be suitable for coating plant elements. When used to coat plant elements, the composition may be applied to the plant elements and allowed to dry. In embodiments wherein the composition is a powder (e.g., a wettable powder), a liquid, such as water, may need to be added to the powder before application to a seed.

In still another embodiment, the methods can include introducing into the soil an inoculum of one or more of the endophyte populations described herein. Such methods can include introducing into the soil one or more of the compositions described herein. The inoculum(s) or compositions may be introduced into the soil according to methods known to those skilled in the art. Non-limiting examples include in-furrow introduction, spraying, coating seeds, foliar introduction, etc. In a particular embodiment, the introducing step comprises in-furrow introduction of the inoculum or compositions described herein.

In one embodiment, plant elements may be treated with composition(s) described herein in several ways but preferably via spraying or dripping. Spray and drip treatment may be conducted by formulating compositions described herein and spraying or dripping the composition(s) onto a seed(s) via a continuous treating system (which is calibrated to apply treatment at a predefined rate in proportion to the continuous flow of seed), such as a drum-type of treater. Batch systems, in which a predetermined batch size of seed and composition(s) as described herein are delivered into a mixer, may also be employed.

In another embodiment, the treatment entails coating plant elements. One such process involves coating the inside wall of a round container with the composition(s) described herein, adding plant elements, then rotating the container to cause the plant elements to contact the wall and the composition(s), a process known in the art as "container coating". Plant elements can be coated by combinations of coating methods. Soaking typically entails using liquid forms of the compositions described. For example, plant elements can be soaked for about 1 minute to about 24 hours (e.g., for at least 1 min, between 1 and 5 min, 5 min, between 5 and 10 min, 10 min, between 10 and 20 min, 20 min, between 20 and 40 min, 40 min, between 40 and 80 min, 80 min, between 80 min and 3 hrs, 3 hrs, between 3 hrs and 6 hrs, 6 hr, between 6 hrs and 12 hrs, 12 hr, between 12 hrs and 24 hrs, or at least 24 hrs).

Populations of Plants, Agricultural Fields

A major focus of crop improvement efforts has been to select varieties with traits that give, in addition to the highest return, the greatest homogeneity and uniformity. While inbreeding can yield plants with substantial genetic identity, heterogeneity with respect to plant height, flowering time, and time to seed, remain impediments to obtaining a homogeneous field of plants. The inevitable plant-to-plant variability are caused by a multitude of factors, including uneven environmental conditions and management practices. Another possible source of variability can, in some cases, be due to the heterogeneity of the microbial population inhabit the plants. By providing a plurality of endophytes to seeds and seedlings, the resulting plants generated by germinating the seeds and seedlings have a more consistent microbial composition, and thus are expected to yield a more uniform population of plants.

Therefore, in another aspect, the invention provides a substantially uniform population of plants. The population comprises at least 100 plants, for example, at least 300 plants, at least 1,000 plants, at least 3,000 plants, at least 10,000 plants, at least 30,000 plants, at least 100,000 plants or more. The plants are grown from the seeds comprising a plurality of endophytes as described herein. The increased uniformity of the plants can be measured in a number of different ways.

In another aspect, the invention provides for a substantially uniform population of plant elements comprising a plurality of plant elements comprising a plurality of endophytes, as described herein above. Substantial uniformity can be determined in many ways. In some cases, at least 10%, between 10% and 20%, for example, at least 20%, between 20% and 30%, at least 30%, between 30% and 40%, at least 40%, between 40% and 50%, at least 50%, between 50% and 60%, at least 60%, between 60% and 70%, at least 70%, between 70% and 75%, at least 75%, between 75% and 80%, at least 80%, between 80% and 90%, at least 90%, between 90% and 95%, at least 95% or more of the plant elements in the population, contains the endophytic population in an amount effective to colonize the plant disposed on the surface of the plant elements. In other cases, at least 10%, between 10% and 20%, for example, at least 20%, between 20% and 30%, at least 30%, between 30% and 40%, at least 40%, between 40% and 50%, at least 50%, between 50% and 60%, at least 60%, between 60% and 70%, at least 70%, between 70% and 75%, at least 75%, between 75% and 80%, at least 80%, between 80% and 90%, at least 90%, between 90% and 95%, at least 95% or more of the plant elements in the population, contains at least 1, between 10 and 10, 10, between 10 and 100, or 100 CFU on the plant element surface or per gram of plant element, for example, between 100 and 200 CFU, at least 200 CFU, between 200 and 300 CFU, at least 300 CFU, between 300 and 1,000 CFU, at least 1,000 CFU, between 1,000 and 3,000 CFU, at least 3,000 CFU, between 3,000 and 10,000 CFU, at least 10,000 CFU, between 10,000 and 30,000 CFU, at least 30,000 CFU, between 30,000 and 100,000 CFU, at least 100,000 CFU, between 100,000 and 300,000 CFU, at least 300,000 CFU, between 300,000 and 1,000,000 CFU, or at least 1,000,000 CFU per plant element or more. Alternatively, in a substantial portion of the population of plants, for example, in at least 1%, at least 10%, at least 20%, at least 30%, at least 40%, at least 50%, at least 60%, at least 70%, at least 75%, at least 80%, at least 90%, at least 95% or more of the plants in the population, a plurality of endophytes that is provided to the plant element represents at least 10%, least 20%, at least 30%, at least 40%, at least 50%, at least 60%, at least 70%, at least 80%, at least 90%, at least 95%, at least 99%, or 100% of the total microbe population in the plant element.

In other embodiments, there is an increased uniformity with respect to a physiological parameter of the plants within the population. In some cases, there can be an increased uniformity in the height of the plants when compared with a population of reference agricultural plants grown under the same conditions. For example, there can be a reduction in the standard deviation in the height of the plants in the population of at least 2%, for example at least 3%, at least 4%, at least 5%, at least 6%, at least 7%, at least 8%, at least 9%, at least 10%, at least 15%, at least 20%, at least 30%, at least 40%, at least 50%, at least 60% or more, when compared with a population of reference agricultural plants grown under the same conditions. In other cases, there can be a reduction in the standard deviation in the flowering time of the plants in the population of at least 2%, for example at least 3%, at least 4%, at least 5%, at least 6%, at least 7%, at least 8%, at least 9%, at least 10%, at least 15%, at least 20%, at least 30%, at least 40%, at least 50%, at least 60% or more, when compared with a population of reference agricultural plants grown under the same conditions.

Commodity Plant Product

The present invention provides a commodity plant product, as well as methods for producing a commodity plant product, that is derived from a synthetic combination of the present invention. As used herein, a "commodity plant product" refers to any composition or product that is comprised of material derived from a plant, seed, plant cell, or plant part of the present invention. Commodity plant products may be sold to consumers and can be viable or nonviable. Nonviable commodity products include but are not limited to nonviable seeds and grains; processed seeds, seed parts, and plant parts; dehydrated plant tissue, frozen plant tissue, and processed plant tissue; seeds and plant parts processed for animal feed for terrestrial and/or aquatic animal consumption, oil, meal, flour, flakes, bran, fiber, paper, tea, coffee, silage, crushed of whole grain, and any other food for human or animal consumption; and biomasses and fuel products; and raw material in industry. Industrial uses of oils derived from the agricultural plants described herein include ingredients for paints, plastics, fibers, detergents, cosmetics, lubricants, and biodiesel fuel. Soybean oil may be split, inter-esterified, sulfurized, epoxidized, polymerized, ethoxylated, or cleaved. Designing and producing soybean oil derivatives with improved functionality and improved oliochemistry is a rapidly growing field. The typical mixture of triglycerides is usually split and separated into pure fatty acids, which are then combined with petroleum-derived alcohols or acids, nitrogen, sulfonates, chlorine, or with fatty alcohols derived from fats and oils to produce the desired type of oil or fat. Commodity plant products also include industrial compounds, such as a wide variety of resins used in the formulation of adhesives, films, plastics, paints, coatings and foams.

In some cases, commodity plant products derived from the synthetic combinations, or using the methods of the present invention can be identified readily. In some cases, for example, the presence of viable endophytes can be detected using the methods described herein. In other cases, particularly where there are no viable endophytes, the commodity plant product may still contain at least a detectable amount of the specific and unique DNA corresponding to the microbes described herein. Any standard method of detection for polynucleotide molecules may be used, including methods of detection disclosed herein.

Throughout the specification, the word "comprise," or variations such as "comprises" or "comprising," will be understood to imply the inclusion of a stated integer or group of integers but not the exclusion of any other integer or group of integers.

Although the present invention has been described in detail with reference to examples below, it is understood that various modifications can be made without departing from the spirit of the invention. For instance, while the particular examples below may illustrate the methods and embodiments described herein using a specific plant, the principles in these examples may be applied to any agricultural crop. Therefore, it will be appreciated that the scope of this invention is encompassed by the embodiments of the inventions recited herein and the specification rather than the specific examples that are exemplified below. All cited patents and publications referred to in this application are herein incorporated by reference in their entirety.

EXAMPLES

Example 1: Selection of Endophytes for Plant Improvement

A plant sample collection, comprising a variety of different crop plants listed in Table 1, was analyzed for the presence and occurrence frequency of both bacterial and fungal endophytes. Seeds from a variety of crops were obtained, soaked in sterile water for 48 hours, briefly rinsed in 100% ethanol, rinsed with 1 ml water, and macerated in a sterile mortar and pestle prior to DNA extraction. Roots from a variety of crops were obtained. Harvesting involved shaking plants free of as much soil/debris as possible, cutting plants into shoot and root, placing them into 15 mL conical tubes along with 10 mL of distilled water, shaken vigorously, then decanting off the dirty water. This washing step was repeated with sterile water until wash water was no longer cloudy (the last rinse coming off of every root was clear). Two sterile carbide beads and 5 mL of sterile water were added to the washed root material in the 15 mL conical tube before homogenizing in a Fastprep-24 homogenizer for 1 minute at 6M vibrations per second. The resulting material was used for DNA extraction. Marker genes were amplified and sequenced from the extracted DNA using a high-throughput protocol. For the bacterial and archaeal analyses, the V4 hypervariable region of the 16S rRNA gene was targeted (primers 515f/806r), and for fungi, the first internal transcribed spacer (ITS1) region of the rRNA operon (primers ITS1f/ITS2r) was targeted. The two marker genes were PCR amplified separately using 35 cycles, and error-correcting 12-bp barcoded primers specific to each sample were used to facilitate combining of samples. PCR products were purified, quantified using the PicoGreen assay (Life Technologies, Inc., Grand Island, N.Y.) and pooled in equimolar concentrations prior to sequencing on an Illumina MiSeq instrument.

Each plant sample was assigned membership into categories based on some property (for example, root, seed, monocot, dicot, monocot root, monocot seed, dicot root, dicot seed, wild, cultivated, wild seed, wild root, *Brassica*, *Brassica* seed, *Brassica* root, Poaceae, Poaceae seed, Poaceae root).

TABLE 1

Plant sample collection

| Crop | Improvement status | Tissue | Number of varieties sampled |
|---|---|---|---|
| *Arabidopsis* | Wild | Root | 8 |
| Barley | Cultivated | Seed | 2 |
| Barley | Landrace | Seed | 2 |
| Barley | Modern | Root | 10 |
| Barley | Modern | Seed | 4 |
| Barley | Wild | Seed | 2 |
| *Brachypodium* | Wild | Root | 8 |
| Cabbage | Cultivated | Seed | 3 |
| Cabbage | Hybrid | Seed | 1 |
| Cabbage | Wild | Seed | 17 |
| Cotton | Landrace | Root | 6 |
| Cotton | Modern | Root | 8 |
| Cotton | Modern | Seed | 14 |
| Cotton | Wild | Root | 8 |
| Lettuce | Cultivated | Seed | 2 |
| Maize | Cultivated | Seed | 11 |
| Maize | Hybrid | Seed | 1 |
| Maize | Inbred | Seed | 20 |
| Maize | Landrace | Root | 8 |
| Maize | Landrace | Seed | 37 |
| Maize | Modern | Root | 16 |
| Maize | Modern | Seed | 17 |
| Maize | Wild | Root | 8 |
| Maize | Wild | Seed | 27 |
| Melon | Cultivated | Seed | 2 |
| Onion | Cultivated | Seed | 5 |
| Onion | Wild | Seed | 5 |
| Potato | Cultivated | Seed | 2 |
| Potato | Landrace | Seed | 1 |
| Rapeseed | Cultivated | Seed | 2 |
| Rapeseed | Wild | Seed | 1 |
| Rice | Cultivated | Seed | 4 |
| Rice | Landrace | Seed | 4 |
| Rice | Modern | Root | 6 |
| Rice | Wild | Seed | 1 |
| Soy | Cultivated | Seed | 4 |
| Soy | Modern | Root | 16 |
| Soy | Modern | Seed | 16 |
| Soy | Wild | Root | 16 |
| Soy | Wild | Seed | 4 |
| Strawberry | Hybrid | Seed | 2 |
| Strawberry | Wild | Seed | 6 |
| Switch Grass | Wild | Seed | 1 |
| Tomato | Cultivated | Seed | 3 |
| Tomato | Hybrid | Seed | 1 |
| Tomato | Modern | Root | 12 |
| Toria | Wild | Seed | 1 |
| Turnip | Cultivated | Seed | 4 |
| Turnip | Wild | Seed | 2 |
| Watermelon | Cultivated | Seed | 1 |
| Watermelon | Hybrid | Seed | 1 |
| Wheat | Landrace | Root | 8 |
| Wheat | Landrace | Seed | 15 |
| Wheat | Modern | Root | 16 |
| Wheat | Modern | Seed | 24 |
| Wheat | Wild | Root | 4 |
| Wheat | Wild | Seed | 10 |

For both 16S rRNA and ITS sequences, the raw sequence data were reassigned to distinct samples based on barcode sequences introduced during library prep, and quality filtering and OTU (i.e. operational taxonomic unit) clustering was conducted using the UPARSE pipeline (Edgar 2013). OTU clustering (Rideout et al. (2014) PeerJ2:e545 available online at doi.org/10.7717/peerj.545) was performed using a cascading approach, comparing the sequences against the Greengenes (McDonald D et al. The ISME Journal (2012) 6, 610-618; doi:10.1038/ismej.2011.139) and SILVA (Quast et al. (2013) Nucl. Acids Res. 41 (D1): D590-D596) and UNITE (Koljalg, U. et al. (2013) Molecular Ecology (2013) 22: 5271-5277) reference databases, which are provided with full-length clustering at various widths. Bacterial sequences were compared to the combined Greengenes 99% OTU representative sequences and SILVA non-redundant sequences. Sequences without a 99% match to the combined reference 99% OTUs but having a 97% match were assigned to 97% OTUs with the best match representative sequence from the 99% reference sequences. Fungal sequences were compared to the UNITE Dynamic OTU representative sequences, where dynamic represents values between 97% and 99% depending on the OTU. Sequences that did not match the UNITE Dynamic OTUs at the appropriate clustering level, but did have a 97% match were assigned to 97% OTUs with best match representative sequence from the Dynamic OTUs. The remaining sequences that did not match any of the three reference databases, Greengenes (McDonald et al., 2012), SILVA (Quast et al., 2013), or UNITE (Koljalg, U. et al., 2013), but were present at a level of at least 10 reads across the samples, were clustered de novo using the -cluster_otus option of USEARCH (Edgar, R. C. (2010) Bioinformatics, 26, 2460-2461) at 97% (independently for the bacterial and fungal sequences). The original sequences were mapped to the de novo OTUs using the same cascading approach, and any sequences that did not match either a reference or de novo OTU were removed from this analysis. Co-occurrence was calculated using the co-occur package in R (Griffith et al. (2016) Journal of Statistical Software, 69(2), 1-17. doi:10.18637/jss.v069.c02).

Pairs of endophytes for crop improvement were selected based on their co-occurrence frequency profiles in subsets of the sample collection, where the subsets of samples shared some identification feature (for example, but not limited to, samples from dicot plants, samples from monocot plants, and samples from root). Exemplary pairs of endophytes are described in Tables 10-16, and their corresponding 16S (bacterial) or ITS (fungal) sequences are in the sequence listing as SEQ ID NO: 1-1703.

Example 2: Isolation and Identification of Bacterial Endophytes

Classification of bacterial strains using 16S sequences was done by the following methodology.

To accurately characterize isolated bacterial endophytes, colonies were submitted for marker gene sequencing, and the sequences were analyzed to provide taxonomic classifications. Colonies were subjected to 16S rRNA gene PCR amplification using a primer pair 27f (5'-AGAGTTTGATYMTGGCTCAG-3') (SEQ ID NO: 1704) and 1492r (5'-GGTTACCTTGTTACGACTT-3') (SEQ ID NO: 1705). Sequencing reactions were performed using primers: 27f (5'-AGAGTTTGATYMTGGCTCAG-3') (SEQ ID NO: 1704), 515f (5'-GTGYCAGCMGCCGCGGTAA-3') (SEQ ID NO: 1706), 806r (5'-GGACTACNVGGGTWTCTAAT-3') (SEQ ID NO: 1707), and 1492r (5'-GGTTACCTTGTTACGACTT-3') (SEQ ID NO: 1705). Preferably sequencing primers are chosen so that overlapping regions are sequenced. Sanger sequencing of was performed at Genewiz (South Plainfield, N.J.). Raw chromatograms are converted to sequences, and corresponding quality scores were assigned using TraceTuner v3.0.6beta (U.S. Pat. No. 6,681,186). These sequences were quality filtered using PRINSEQ v0.20.3 (Schmieder and Edwards (2011) Bioinformatics 2011 27:863-864) with left and right trim quality score thresholds of 30 and a quality window of 20 bp. Sequences were aligned and a consensus sequence generated using Geneious v 8.1.8 (Biomatters Limited, Auckland NZ). Taxonomic classifications were assigned to the sequences using the highest probability of assignment based on the results of industry standard taxonomic classification tools: LCA (runs USEARCH (Edgar, R. C., 2010) with option search_global, then for all best match hits, returns lowest taxonomic rank shared by all best hits for a query), RDP Naive Bayesian rRNA Classifier version 2.11, September 2015 (Wang et al., 2007), SPINGO version 1.3 (32 bit) (Allard et al. (2015) BMC Bioinformatics 16:324 DOI: 10.1186/s12859-015-0747-1), and UTAX version v8.1.1861_i86linux64 (Edgar, R. C. (2016) available online at drive5.com/usearch/manual/utax_algo.html), using reference databases: RDP 16S rRNA training set 15 (Cole et al., 2014), and SILVA version 119 (Quast et al., 2013). The classifier and database combinations listed in Table 1 were used to assign taxonomy to bacterial sequences.

TABLE 2

The classifier and database combinations used to classify 16S sequences.

| Classifier | Database |
|---|---|
| LCA | SILVA, version 119 |
| RDP | RDP, 16S rRNA training set 15 |
| SPINGO | RDP, 16S rRNA training set 15 |
| UTAX | RDP, 16S rRNA training set 15 |
| | SILVA, version 119 |

Example 3: Identification and Isolation of Fungal Endophytes

Classification of fungal strains using ITS sequences is done by the following methodology.

Total genomic DNA is extracted from individual fungal isolates, using the DNeasy Plant Mini Kit (Qiangen, Germantown, Md.). Polymerase Chain Reaction (PCR) is used to amplify a genomic region including the nuclear ribosomal internal transcribed spacers (ITS) using a primer pair ITS_1 (5'-CTTGGTCATTTAGAGGAAGTAA-3') (SEQ ID NO:1708) and LR5 (5'-TCCTGAGGGAAACTTCG-3') (SEQ ID NO: 1711). Each 25 microliter-reaction mixture includes 22.5 microliters of Invitrogen Platinum Taq supermix, 0.5 microliter of each primer (10 uM), and 1.5 microliters of DNA template (~2-4 ng). Cycling reactions are run with MJ Research PTC thermocyclers and consisted of 94° C. for 5 min, 35 cycles of 94° C. for 30 s, 54° C. for 30 s, and 72° C. for 1 min, and 72° C. for 10 min. Sanger sequencing is performed using an ABI 3730×1 DNA Analyzers for capillary electrophoresis and fluorescent dye terminator detection.

PCR reactions are purified to remove primers, dNTPs, and other components by methods known in the art, for example by the use of commercially available PCR clean-up kits, or 3M sodium acetate and washed in absolute ethanol as described below, and re-suspended in sterile water. DNA amplicons are then sequenced using methods known in the art, for example Sanger sequencing (Johnston-Monje & Raizada. PLoS One 6.6 (2011): e20396.) using primers: ITS_1 (5'-CTTGGTCATTTAGAGGAAGTAA-3') (SEQ ID NO: 1708), ITS_2 (5'-GCTGCGTTCTTCATCGATGC-3') (SEQ ID NO: 1709), ITS_3 (5'-GCATCGATGAAGAACGCAGC-3') (SEQ ID NO: 1710), and LR5 (5'-TCCTGAGGGAAACTTCG-3') (SEQ ID NO: 1711). Preferably sequencing primers are chosen so that overlapping regions are sequenced. Taxonomic classifications were assigned to the sequences using the highest probability of assignment based on the results of industry standard taxonomic classification tools: LCA (runs USEARCH (Edgar, R. C., 2010) with option search_global, then for all best match hits, returns lowest taxonomic rank shared by all best hits for a query), SPINGO (Allard et al., 2015), and UTAX (Edgar, R. C., 2016), using the WARCUP Fungal ITS trainset 1 (Deshpande et al. (2016) Mycologia 108(1):1-5) and UNITE (Koljalg et al., 2013). The classifier and database combinations listed in Table 2 were used to assign taxonomy to fungal sequences.

TABLE 3

The classifier and database combinations used to classify ITS sequences.

| Classifier | Database |
|---|---|
| LCA | UNITE, Fungal ITS trainset Jul. 4, 2014 |
| RDP | UNITE, Fungal ITS trainset Jul. 4, 2014 |
| | WARCUP, Fungal ITS trainset 1 |
| SPINGO | UNITE, Fungal ITS trainset Jul. 4, 2014 |
| UTAX | UNITE, Fungal ITS trainset Jul. 4, 2014 |
| | WARCUP, Fungal ITS trainset 1 |

Example 4: Mapping Isolated Bacterial and Fungal Endophytes to Universal OTUs

The following procedure was used to identify bacterial and fungal endophytes that are representative of microbes identified by community sequencing in Example 1. 16S and ITS sequences obtained via the methods described in Examples 2 and 3 were mapped to a set of 16S and ITS community sequencing reads (described in Example 1) using USEARCH (Edgar, R. C., 2010). USEARCH was run with the usearch_global option, requiring that the target sequence must span at least 85% of the query sequence and that the percent identity, calculated for the entire overlap region, is at least 97%. To further ensure that the best match is found, the complete target set is tested (options maxaccepts=0 and maxrejects=0).

Example 5: Preparation of Synthetic Combinations Comprising Plant Seeds and a Plurality of Bacterial Endophyte Strains for Greenhouse and Field Trials The following procedure is used to coat seeds with a plurality of bacterial inocula for planting in greenhouse and field trials. First, 3% sodium alginate (SA) is prepared and autoclaved in the following manner. Erlenmeyer flasks are filled with the appropriate amount of deionized water and warmed to about 50 degrees C. on a heat plate with agitation using a stirring bar. SA powder is poured slowly into the water until it all dissolved. The solution is autoclaved (121° C. @15 PSI for 30 minutes). Talcum powder is autoclaved in dry cycle (121° C. @15 PSI for 30 minutes) and aliquoted in Ziploc bags or 50 ml falcon tubes at a ratio of 15 g per kg of seed to be treated for formulation controls and 10g per kg of seed for actual treatments. The next day, seeds are treated with either powdered or liquid formulations.

For powdered formulations, 10 g per kg of seed is allocated to the seeds to be treated, according to the following procedure. Seeds are placed in large plastic container. 16.6 ml of 2% SA per Kg of seeds to be treated are poured on the seeds. The container is covered and shaken slowly in orbital motion for about 20 seconds to disperse the SA. Endophyte powder is mixed with an equal amount of talcum powder. The mix of endophytes and talc is added on top of the seeds, trying to disperse it evenly. The container is covered and seeds are shaken slowly in orbital motion for about 20 seconds. 13.3 ml of Flo-rite per kg of seed to be treated is poured on the seeds. Seeds are shaken again, slowly and in orbital motion.

For liquid formulations, seeds are treated according to the following procedure. Seeds are placed in large plastic container. Equal volumes each of 2% SA and bacterial culture are poured on the seeds. The container is covered and shaken slowly in orbital motion for about 20 seconds to disperse the SA. 15 g of talcum powder per kg of seed are added, trying to disperse it evenly. The container is covered and seeds are shaken slowly in orbital motion for about 20 seconds. 13.3 ml of Flo Rite® per kg of seed to be treated is poured on the seeds. Seeds are shaken again, slowly and in orbital motion.

Example 6: Preparation of Synthetic Combinations Comprising Plant Seeds and Fungal Endophyte Strains for Greenhouse and Field Trials The following procedure is used to coat seeds with a plurality of fungal endophyte inocula for planting in greenhouse and field trials. First, 3% Sodium alginate (SA) is prepared and autoclaved in the following manner. Erlenmeyer flasks are filled with the appropriate amount of deionized water and warmed to about 50 degrees C. on a heat plate with agitation using a stirring bar. SA powder is poured slowly into the water until it all dissolved. The solution is autoclaved (121° C. @15 PSI for 30 minutes). Talcum powder is autoclaved in dry cycle (121° C. @15 PSI for 30 minutes) and aliquoted in Ziploc bags or 50 ml falcon tubes at a ratio of 15 g per kg of seed to be treated for formulation controls and 10g per kg of seed for actual treatments. The next day, seeds are treated with either powdered or liquid formulations.

For powdered formulations, 10 g per kg of seed is allocated to the seeds to be treated, according to the following procedure. Seeds are placed in large plastic container. 16.6 ml of 2% SA per Kg of seeds to be treated are poured on the seeds. The container is covered and shaken slowly in orbital motion for about 20 seconds to disperse the SA. Endophyte powder is mixed with an equal amount of talcum powder. The mix of endophytes and talc is added on top of the seeds, trying to disperse it evenly. The container is covered and seeds are shaken slowly in orbital motion for about 20 seconds. 13.3 ml of Flo Rite® per kg of seed to be treated is poured on the seeds. Seeds are shaken again, slowly and in orbital motion.

For liquid formulations, 8.5 mL per seed is allocated to the seeds to be treated, according to the following procedure. Seeds are placed in large plastic container. 8.3 ml of 2% SA per kg of seed and the same amount of bacterial culture (8.3 ml per kg of seed) is poured on the seeds. The container is covered and shaken slowly in orbital motion for about 20 seconds to disperse the SA. 15 g of talcum powder per kg of seed is added, trying to disperse it evenly. The container is covered and seeds are shaken slowly in orbital motion for about 20 seconds. 13.3 ml of Flo Rite® per kg of seed to be treated are poured on the seeds. Seeds are shaken again, slowly and in orbital motion.

Example 7: Mechanisms of Inoculation of Plant Elements with a Plurality of Bacterial or Fungal Endophytes Seed Treatment A plurality of fungal or bacterial endophytes is inoculated onto seeds as a liquid or powder using a range of formulations including the following components; sodium alginate and/or methyl cellulose as stickers, talc and flowability polymers. Seeds are air dried after treatment and planted according to common practice for each crop type.

Osmopriming and Hydropriming

A plurality of fungal or bacterial endophytes is inoculated onto seeds during the osmopriming (soaking in polyethylene glycol solution to create a range of osmotic potentials) and/or hydropriming (soaking in de-chlorinated water) process. Osmoprimed seeds are soaked in a polyethylene glycol solution containing a bacterial and/or fungal endophyte for one to eight days and then air dried for one to two days. Hydroprimed seeds are soaked in water for one to eight days containing a plurality of bacterial and/or fungal endophytes and maintained under constant aeration to maintain a suitable dissolved oxygen content of the suspension until removal and air drying for one to two days. Talc and or flowability polymer are added during the drying process.

Foliar Application

A plurality of fungal or bacterial endophytes is inoculated onto aboveground plant tissue (leaves and stems) as a liquid suspension in dechlorinated water containing adjuvants, sticker-spreaders and UV protectants. The suspension is sprayed onto crops with a boom or other appropriate sprayer.

Soil Inoculation

A plurality of fungal or bacterial endophytes is inoculated onto soils in the form of a liquid suspension either; pre-planting as a soil drench, during planting as an in furrow application, or during crop growth as a side-dress. The plurality of fungal or bacterial endophytes is mixed directly into a fertigation system via drip tape, center pivot or other appropriate irrigation system.

Hydroponic and Aeroponic Inoculation

A plurality of fungal or bacterial endophyte is inoculated into a hydroponic or aeroponic system either as a powder or liquid suspension applied directly to the rockwool substrate, or applied to the circulating or sprayed nutrient solution.

Vector-Mediated Inoculation

A plurality of fungal or bacterial endophyte is introduced in power form in a mixture containing talc or other bulking agent to the entrance of a beehive (in the case of bee-mediation) or near the nest of another pollinator (in the case of other insects or birds. The pollinators pick up the powder when exiting the hive and deposit the inoculum directly to the crop's flowers during the pollination process.

Root Wash

The method includes contacting the exterior surface of a plant's roots with a liquid inoculant formulation containing a plurality of purified bacterial population, a plurality of purified fungal population, or a mixture of purified bacteria and fungi. The plant's roots are briefly passed through standing liquid microbial formulation or liquid formulation is liberally sprayed over the roots, resulting in both physical removal of soil and microbial debris from the plant roots, as well as inoculation with microbes in the formulation.

Seedling Soak

The method includes contacting the exterior surfaces of a seedling with a liquid inoculant formulation containing a plurality of purified bacterial population, a plurality of purified fungal population, or a mixture of purified bacteria and fungi. The entire seedling is immersed in standing liquid microbial formulation for at least 30 seconds, resulting in both physical removal of soil and microbial debris from the plant roots, as well as inoculation of all plant surfaces with microbes in the formulation. Alternatively, the seedling can be germinated from seed in or transplanted into media soaked with the microbe(s) of interest and then allowed to grow in the media, resulting in soaking of the plantlet in microbial formulation for much greater time totaling as much as days or weeks.

Wound Inoculation

The method includes contacting the wounded surface of a plant with a liquid or solid inoculant formulation containing a plurality of purified bacterial population, a plurality of purified fungal population, or a mixture of purified bacteria and fungi. Plant surfaces are designed to block entry of microbes into the endosphere, since pathogens attempting to infect plants in this way. In order to introduce beneficial endophytes to plant endospheres, we need a way to access the interior of the plant which we can do by opening a passage by wounding. This wound can take a number of forms, including pruned roots, pruned branches, puncture wounds in the stem breaching the bark and cortex, puncture wounds in the tap root, puncture wounds in leaves, and puncture wounds seed allowing entry past the seed coat. Wounds can be made using needles, hammer and nails, knives, drills, etc. The wound can then be contacted the microbial inoculant as liquid, as powder, inside gelatin capsules, in a pressurized capsule injection system, in a pressurized reservoir and tubing injection system, allowing entry and colonization by microbes into the endosphere. Alternatively, the entire wounded plant can be soaked or washed in the microbial inoculant for at least 30 seconds, giving more microbes a chance to enter the wound, as well as inoculating other plant surfaces with microbes in the formulation—for example pruning seedling roots and soaking them in inoculant before transplanting is a very effective way to introduce endophytes into the plant.

Injection

The method includes injecting microbes into a plant in order to successfully install them in the endosphere. Plant surfaces are designed to block entry of microbes into the endosphere, since pathogens attempting to infect plants in this way. In order to introduce beneficial endophytes to endospheres, we need a way to access the interior of the plant which we can do by puncturing the plant surface with a need and injecting microbes into the inside of the plant. Different parts of the plant can be inoculated this way including the main stem or trunk, branches, tap roots, seminal roots, buttress roots, and even leaves. The injection can be made with a hypodermic needle, a drilled hole injector, or a specialized injection system, and through the puncture wound can then be contacted the microbial inoculant as liquid, as powder, inside gelatin capsules, in a pressurized capsule injection system, in a pressurized reservoir and tubing injection system, allowing entry and colonization by microbes into the endosphere.

Example 8: Greenhouse Characterization

Setup and Watering Conditions

A sandy loam growth substrate is mixed in the greenhouse and consisting of 60% loam and 40% mortar sand (Northeast Nursery, Peabody, Mass.). Prior to mixing, loam is sifted through a ⅜" square steel mesh screen to remove larger particles and debris. Half of the appropriate fertilizers and soil treatments to be applied during the season is added to the soil mixture prior to sowing. The remaining components are provided dissolved in irrigation water at the onset of the reproductive stages of development. Substrate surface area per pot is calculated based on pot diameter in order to approximate the "acreage" of individual pots. An equivalent volume of fertilized soil is then gently added to each pot in order to minimize compaction of the soil. The substrate is saturated with water 3-4 hours before sowing.

Commercially available maize seeds are coated with microbial treatments using the formulation used for field trials and described herein. Treatments included microbial coatings and two controls (non-treated and formulation). Three seeds are sown evenly spaced at the points of a triangle. Soil is then overlaid atop the seeds and an additional 200 mL water was added to moisten the overlaying substrate.

Midseason Measurements and Harvest

Emergence percentage is observed. Further, at various times through the growing season, plants are assessed for onset of and recovery from stress symptoms, for example but not limited to: leaf senescence, anthesis-silking interval, leaf chlorophyll content, grain weight, and total yield.

To compare treated plants to controls, a fully Bayesian robust t-test is performed. Briefly, R (R Core Team, 2015) was used with the BEST package (Kruschke, J. K., and M. Meredith. "BEST: Bayesian Estimation Supersedes the t-Test. R Package Version 0.2.2." (2015).) and JAGS (Plummer, M. et al., JAGS: A program for analysis of Bayesian graphical models using Gibbs sampling Proceedings of the 3rd international workshop on distributed statistical computing, 2003, 124, 125) to perform a Markov Chain Monte Carlo estimation of the posterior distribution the likely differences between the two experimental groups. A 95% highest density interval (HDI) is overlayed onto this distribution to aid in the interpretation of whether the two biological groups truly differ.

Tissue collection and processing for transcriptomics, hormone, and metabolomics analysis: In order to assess the effects of endophyte treatment on plant growth at the transcriptomic, phytohormone, and metabolomic levels, plants are harvested. Three pots from each treatment are selected. Once separated, the tissues (roots, stems, leaves, other plant elements as appropriate) from the three pots of each treatment are pooled. For collection, first all loosely attached substrate is removed from the roots by gently tapping and shaking the roots. Any adherent substrate is removed by submerging the roots in water and manually dislodging attached soil and debris. The roots are then blotted dry before being cut from the aerial tissue, followed by separating petioles and leaves from the stem. As tissues are removed from the plant they are immediately bagged and frozen in liquid nitrogen. All harvested tissues are kept in liquid nitrogen or stored at −80° C. until further processing.

To prepare for analyses, the tissues are ground with liquid nitrogen using a pre-chilled mortar and pestle. Approximately 100-200 micrograms of each ground sample pool is transferred to a chilled 1.5 mL microtube for RNA extraction and subsequent transcriptome, phytohormone and metabolite analysis. For proteomic analysis, 3 g of each ground sample pool is used. The remaining ground tissue is then transferred to a chilled 50 mL conical tube and stored in liquid nitrogen or at −80° C. until shipment for further analyses.

Example 9: Assessment of Plant Colonization

The protocols described in this section allow confirmation of successful colonization of plants by endophytes, for example by direct recovery of viable colonies from various tissues of the inoculated plant.

Recovery of Viable Colonies from Seeds

Seeds are surface-sterilized by exposing them to chlorine gas overnight, using the methods described elsewhere. Sterile seeds are then inoculated with submerged in 0.5 OD overnight cultures (Tryptic Soy Broth, TSB) of bacteria and allowed to briefly air dry. The seeds are then placed in tubes filled partially with a sterile sand-vermiculite mixture [(1:1 wt:wt)] and covered with 1 inch of the mixture, watered with sterile water, sealed and incubated in a greenhouse for 7 days. After incubation, various tissues of the plants are harvested and used as donors to isolate bacteria by placing tissue section in a homogenizer (TSB 20%) and mechanical mixing. The slurry is then serially diluted in 10-fold steps to 10-3 and dilutions 1 through 10-3 are plated on TSA 20% plates (1.3% agar). Plates are incubated overnight and pictures are taken of the resulting plates as well as colony counts for CFU. Bacteria are identified visually by colony morphotype and molecular methods described herein. Representative colony morphotypes are also used in colony PCR and sequencing for isolate identification via ribosomal gene sequence analysis as described herein. These trials are repeated twice per experiment, with 5 biological samples per treatment.

Culture-Independent Methods to Confirm Colonization of the Plant or Seeds by Bacteria or Fungi One way to detect the presence of endophytes on or within plants or seeds is to use quantitative PCR (qPCR). Internal colonization by the endophyte can be demonstrated by using surface-sterilized plant tissue (including seed) to extract total DNA, and isolate-specific fluorescent MGB probes and amplification primers are used in a qPCR reaction. An increase in the product targeted by the reporter probe at each PCR cycle therefore causes a proportional increase in fluorescence due to the breakdown of the probe and release of the reporter. Fluorescence is measured by a quantitative PCR instrument and compared to a standard curve to estimate the number of fungal or bacterial cells within the plant.

Experimental Description

The design of both species-specific amplification primers, and isolate-specific fluorescent probes are well known in the art. Plant tissues (seeds, stems, leaves, flowers, etc.) are pre-rinsed and surface sterilized using the methods described herein.

Total DNA is extracted using methods known in the art, for example using commercially available Plant-DNA extraction kits, or the following method.

1. Tissue is placed in a cold-resistant container and 10-50 mL of liquid nitrogen is applied. Tissues are then macerated to a powder.
2. Genomic DNA is extracted from each tissue preparation, following a chloroform:isoamyl alcohol 24:1 protocol (Sambrook et al., 1989).

Quantitative PCR is performed essentially as described by Gao et al. (Gao, et al. "Quantitation of major human cutaneous bacterial and fungal populations." Journal of clinical microbiology 48(10): 3575-3581. 2010.) with primers and probe(s) specific to the desired isolate using a quantitative PCR instrument, and a standard curve is constructed by using serial dilutions of cloned PCR products corresponding to the specie-specific PCR amplicon produced by the amplification primers. Data are analyzed using instructions from the quantitative PCR instrument's manufacturer software.

As an alternative to qPCR, Terminal Restriction Fragment Length Polymorphism, (TRFLP) can be performed, essentially as described in Johnston-Monje and Raizada (2011). Group specific, fluorescently labelled primers are used to amplify a subset of the microbial population, especially bacteria, especially fungi, especially archaea, especially viruses. This fluorescently labelled PCR product is cut by a restriction enzyme chosen for heterogeneous distribution in the PCR product population. The enzyme cut mixture of fluorescently labelled and unlabeled DNA fragments is then submitted for sequence analysis on a Sanger sequence platform such as the Applied Biosystems 3730 DNA Analyzer.

Immunological Methods to Detect Microbes in Seeds and Vegetative Tissues

A polyclonal antibody is raised against specific bacteria X or fungus Y strains via standard methods. A polyclonal antibody is also raised against specific GUS and GFP proteins via standard methods. Enzyme-linked immunosorbent assay (ELISA) and immunogold labeling is also conducted via standard methods, briefly outlined below.

Immunofluorescence microscopy procedures involve the use of semi-thin sections of plant element or adult plant tissues transferred to glass objective slides and incubated with blocking buffer (20 mM Tris (hydroxymethyl)-aminomethane hydrochloride (TBS) plus 2% bovine serum albumin, pH 7.4) for 30 min at room temperature. Sections are first coated for 30 min with a solution of primary antibodies and then with a solution of secondary antibodies (goat anti-rabbit antibodies) coupled with fluorescein isothiocyanate (FITC) for 30 min at room temperature. Samples are then kept in the dark to eliminate breakdown of the light-sensitive FITC. After two 5-min washings with sterile potassium phosphate buffer (PB) (pH 7.0) and one with double-distilled water, sections are sealed with mounting buffer (100 mL 0.1 M sodium phosphate buffer (pH 7.6) plus 50 mL double-distilled glycerine) and observed under a light microscope equipped with ultraviolet light and a FITC Texas-red filter.

Ultrathin (50- to 70-nm) sections for TEM microscopy are collected on pioloform-coated nickel grids and are labeled with 15-nm gold-labeled goat anti-rabbit antibody. After being washed, the slides are incubated for 1 h in a 1:50 dilution of 5-nm gold-labeled goat anti-rabbit antibody in IGL buffer. The gold labeling is then visualized for light microscopy using a BioCell silver enhancement kit. Toluidine blue (0.01%) is used to lightly counterstain the gold-labeled sections. In parallel with the sections used for immunogold silver enhancement, serial sections are collected on uncoated slides and stained with 1% toluidine blue. The sections for light microscopy are viewed under an optical microscope, and the ultrathin sections are viewed by TEM.

Example 10: Assessment of Improved Plant Characteristics: Differentially Expressed Genes Methods For the transcriptomics study, whole RNA is extracted from ground plant tissue over dry ice using the QIAgen Plant RNeasy mini kit (Catalog number 74904) per the manufacturer's instructions with minor modification. DNase treatment is performed on the column with the QIAgen RNase-free DNase kit (Catalog number 79254). The RW1 buffer wash is divided into two washes of half the buffer volume suggested by the manufacturer with the DNase treatment applied in between. After elution, RNA samples are kept on dry ice or at −20° C. until shipping. For transcriptome data acquisition, 1.5 micrograms of whole RNA is sent to a vendor.

To calculate expression values, transcript cDNA sequences is first aligned to the set of identified genes in the maize genome. Sequence read counts for each sample and gene are next normalized to account for differences in the number of reads per sample and differences in gene lengths. More specifically, raw sequence counts per gene are multiplied by a value representing the mean total number of reads aligned to the gene across all samples divided by the total number of aligned reads for a given sample. This value is then divided by the length of the gene it mapped to in order to eliminate gene length biases. The resulting values are considered to be the expression value.

The resulting expression values and their respective transcripts re filtered to reduce the influence of spurious observations. All observations with expression values lower than 10 are removed from downstream analysis. In addition, transcripts that mapped to genes without function information (i.e. 'uncharacterized protein') are not considered further. Fold changes between control and treated samples are calculated for each transcript by dividing the expression value from the treated sample by the expression value from the control sample. Gene ontology terms (functional categories) are determined for each transcript by referencing the Ensembl database (available online at ensembl.gramene.org) using their respective genes.

Modulation of genes related to growth as well as related to resistance to abiotic and biotic stresses are found in plants treated with endophytes as compared to isoline plants lacking such treatment.

Example 11: Assessment of Improved Plant Characteristics: Differentially Regulated Hormones Methods For hormone analysis, 100±10 mg tissue is measured into microtubes (chilled with liquid nitrogen), and sent on dry ice to the lab of Dr. Michael Kolomiets in the Department of Plant Pathology and Microbiology at Texas A&M University. Plant hormone analysis is performed per Christiansen et al. (2014) with slight modification. Briefly, hormones are extracted from 100±10 mg of frozen tissue and tissue weights are recorded for quantification. A mixture containing 10 microliters of 2.5 microMolar internal standards and 500 microliters of extraction buffer [1-propanol/H2O/concentrated HCl (2:1:0.002, vol/vol/vol) is added to each sample and vortexed until thawed. Samples are agitated for 30 min at 4° C., then 500 microliters of dichloromethane (CH2Cl2) is added. Samples are agitated again for 30 min at 4° C., and then centrifuged at 13,000×g for 5 min. in darkness. The lower organic layer is removed into a glass vial and the solvent is evaporated by drying samples for 30-40 min under a N2 stream. Samples are re-solubilized in 150 microliters of MeOH, shaken for 1 min and centrifuged at 14,000×g for 2 min. A supernatant of 90 microliters is transferred into the autosampler vial and hormones are analyzed by ultraperformance liquid chromatography, coupled to mass spectrometry (UPLC-MS/MS). Ascentis Express C-18 Column (3 cm×2.1 mm, 2.7 cm) is connected to an API 3200 using electrospray ionization-tandem mass spectrometry (MS/MS) with scheduled multiple reaction monitoring (SMRM). The injection volume is 5 microliters and has a 300 microliters/min mobile phase consisting of Solution A (0.05% acetic acid in water) and Solution B (0.05% acetic acid in acetonitrile) with a gradient consisting of (time–% B): 0.3-1%, 2-45%, 5-100%, 8-100%, 9-1%, 11—stop. Quantitation is carried out with Analyst software (AB Sciex), using the internal standards as a reference for extraction recovery. Leaf, root, and/or other tissue is saved in −62° C. and saved for subsequent gene expression analysis.

Mass spectra of plant hormones are obtained. Fold changes between control and treated samples are calculated by dividing the mass spectrum value from the treated sample by the value from the control sample.

Modulation of hormones related to growth as well as related to resistance to abiotic and biotic stresses are found in maize plants treated with endophytes as compared to isoline maize plants lacking such treatment.

Example 12: Assessment of Improved Plant Characteristics and Differentially Regulated Metabolites Methods For metabolite analysis, 150±10 mg of each sample is transferred into 1.5 mL microtubes (chilled in liquid nitrogen) and sent on dry ice to the Proteomics and Metabolomics Facility at Colorado State University. Metabolomics data acquisition is performed per the following methods provided by Dr. Corey Broeckling at CSU. To prepare the samples for analysis, phytohormones are extracted from ground plant material using a biphasic protocol. One mL of a methyl tert-butyl ether (MTBE):methanol:water mixture (6:3:1) is added to each sample then shaken for 1 hour. Next, 250 microliters cold water and a mix of internal standards are added to each sample to promote phase separation. Samples are shaken again for 5 minutes. Samples are then centrifuged at 2,095×g at 4° C. for 15 minutes. The organic top phase is removed for hormone analysis, dried under an inert nitrogen environment, then re-suspended in 400 microliters of 50% acetonitrile. Extracts are then directly analyzed by LC-MS.

For GC-MS, the polar (lower phase) extract is dried using a speedvac, resuspended in 50 microliters of pyridine containing 50 mg/mL of methoxyamine hydrochloride, incubated at 60° C. for 45 min, sonicated for 10 min, and incubated for an additional 45 min at 60° C. Next, 25 microliters of N-methyl-N-trimethylsilyltrifluoroacetamide with 1% trimethylchlorosilane (MSTFA+1% TMCS, Thermo Scientific) is added and samples re incubated at 60° C. for 30 min, centrifuged at 3000×g for 5 min, cooled to room temperature, and 80 microliters of the supernatant is transferred to a 150 microliters glass insert in a GC-MS autosampler vial. Metabolites are detected using a Trace GC Ultra coupled to a Thermo ISQ mass spectrometer (Thermo Scientific, Waltham Mass.). Samples are injected in a 1:10 split ratio twice in discrete randomized blocks. Separation occurs using a 30 m TG-5MS column (Thermo Scientific, 0.25 mm i.d., 0.25 micrometer film thickness) with a 1.2 mL/min helium gas flow rate, and the program consists of 80° C. for 30 sec, a ramp of 15° C. per min to 330° C., and an 8 min hold. Masses between 50-650 m/z re scanned at 5 scans/sec after electron impact ionization. The ionization source is cleaned and retuned and the injection liner replaced between injection replicates. Analysis for plant hormones is performed by UPLC-MS/MS as follows.

Metabolites are detected and mass spectra annotated by comparing to libraries of known spectra including an in-house database at CSU (LC-MS only), the National Institute of Standards and Technology databases, Massbank MS database, and the Golm Metabolite Database. Initial annotation is automated, followed by manual validation of annotations. Following annotation, compounds are identified. After removal of technical artifacts (e.g. siloxane), and ambiguous or vague annotations (e.g. carbohydrate or saccharide), identified compounds remain for analysis. These compounds are assessed for fold change over control plants. Metabolites are grouped by pathways (e.g. carbohydrate metabolism or alkaloid biosynthesis) and the KEGG database and literature are manually referenced to identify pertinent shifts in metabolic patterns in plants treated with microbes. Any compound without an appreciable shift compared to that observed in control plants is removed from further analysis.

Modulation of metabolites related to growth as well as related to resistance to abiotic and biotic stresses are found in maize plants treated with endophytes as compared to isoline maize plants lacking such treatment.

Example 13: Assessment of Improved Plant Characteristics and Differentially Regulated Proteins Method
Sample Preparation for Proteomics Analysis 1 mL of 5% SDS 1 mM DTT is added to 1 mL of homogenized tissue and the samples are boiled for 5 m. The samples are cooled on ice and 2 mL of 8M urea solution is added. The samples are spun for 20 m at 14,000 rpm and the soluble phase recovered. A 25% volume of 100% TCA solution is added to the soluble phase, left on ice for 20 m and centrifuged for 10 m at 14,000 rpm. The protein pellet is washed twice with ice-cold acetone and solubilized in 125 µL 0.2M NaOH and neutralized with 125 µL of 1M Tris-Cl pH 8.0. Protein solutions are diluted in THE (50 mM Tris-Cl pH8.0, 100 mM NaCl, 1 mM EDTA) buffer. RapiGest SF reagent (Waters Corp., Milford, Mass.) is added to the mix to a final concentration of 0.1% and samples are boiled for 5 min. TCEP (Tris (2-carboxyethyl) phosphine) is added to 1 mM (final concentration) and the samples are incubated at 37° C. for 30 min. Subsequently, the samples are carboxymethylated with 0.5 mg ml-1 of iodoacetamide for 30 min at 37° C. followed by neutralization with 2 mM TCEP (final concentration). Proteins samples prepared as above are digested with trypsin (trypsin:protein ratio—1:50) overnight at 37° C. RapiGest is degraded and removed by treating the samples with 250 mM HCl at 37° C. for 1 h followed by centrifugation at 14,000 rpm for 30 min at 4° C. The soluble fraction is then added to a new tube and the peptides are extracted and desalted using Aspire RP30 desalting columns (Thermo Scientific). The trypsinized samples are labeled with isobaric tags (iTRAQ, ABSCIEX, Ross et al 2004), where each sample is labeled with a specific tag to its peptides.

Mass Spectrometry Analysis

Each set of experiments (samples 1-6; 7, 8; 9-12; 13-16; 17-20) is then pooled and fractionated using high pH reverse phase chromatography (HPRP-Xterra C18 reverse phase, 4.6 mm×10 mm 5 µm particle (Waters)). The chromatography conditions are as follows: the column is heated to 37° C. and a linear gradient from 5-35% B (Buffer A-20 mM ammonium formate pH10 aqueous, Buffer B-20 mM ammonium formate pH10 in 80% ACN-water) is applied for 80 min at 0.5 ml min-1 flow rate. A total of 30 fractions of 0.5 ml volume are collected for LC-MS/MS analysis. Each of these fractions is analyzed by high-pressure liquid chromatography (HPLC) coupled with tandem mass spectroscopy (LC-MS/MS) using nanospray ionization. The nanospray ionization experiments are performed using a TripleTof 5600 hybrid mass spectrometer (AB SCIEX Concord, Ontario, Canada)) interfaced with nano-scale reversed-phase HPLC (Tempo, Applied Biosystems (Life Technologies), CA, USA) using a 10 cm-180 micron ID glass capillary packed with 5 µm C18 Zorbax™ beads (Agilent Technologies, Santa Clara, Calif.). Peptides are eluted from the C18 column into the mass spectrometer using a linear gradient (5-30%) of ACN (Acetonitrile) at a flow rate of 550 µl min-1 for 100 min. The buffers used to create the ACN gradient are: Buffer A (98% H2O, 2% ACN, 0.2% formic acid, and 0.005% TFA) and Buffer B (100% ACN, 0.2% formic acid, and 0.005% TFA). MS/MS data are acquired in a data-dependent manner in which the MS1 data is acquired for 250 ms at m/z of 400 to 1250 Da and the MS/MS data is acquired from m/z of 50 to 2,000 Da. For independent data acquisition (IDA), parameters are MS1-TOF 250 ms, followed by 50 MS2 events of 25 ms each. The IDA criteria, over 200 counts threshold, charge state +2-4 with 4 s exclusion. Finally, the collected data are analyzed using Protein Pilot 4.0 (AB SCIEX) for peptide identifications and quantification.

Example 14: Efficacy Testing of Endophytes in Crop Production

Method

Whole plants or plant elements, such as seeds, roots, or leaves, from any of the crops useful in the invention are treated with endophytes as described in Examples, 4, 5, 6, or 7. They are then sown in a variety in different growing regions for efficacy testing. Trials consist of ten replicate plots for each treatment and control respectively arranged in a spatially balanced randomized complete block design (Van Es et al. 2007). In addition to measuring total yield, metrics such as seedling emergence, normalized difference vegetation index (NDVI) and time to flowering are assessed. Endophytes are applied alone as a seed treatment, as well as in combination with other endophytes.

Results

Crop plants that have been treated with the endophyte(s) of the present invention demonstrate improvements in one or more agronomically-important characteristic, for example but not limited to: disease resistance, drought tolerance, heat tolerance, cold tolerance, salinity tolerance, metal tolerance, herbicide tolerance, chemical tolerance, improved water use efficiency, improved nitrogen utilization, improved nitrogen fixation, pest resistance, herbivore resistance, pathogen resistance, increased yield, increased yield under water-limited conditions, health enhancement, vigor improvement, growth improvement, photosynthetic capability improvement, nutrition enhancement, altered protein content, altered oil content, increased biomass, increased shoot length, increased root length, improved root architecture, improved plant standability, increased plant element weight, altered plant element carbohydrate composition, altered plant element oil composition, number of pods, delayed senescence, stay-green, and altered plant element protein composition.

Example 15: Methods of Preparing Bacterial Broth Inoculum of Endophyte Strains for Seedling Vigor Assays An agar plug of each bacterial strain was transferred using a transfer tube to 4 mL of potato dextrose broth (PDB) in a 24 well plate and incubated at room temperature at 675 rpm on a shaker for 3 days. After growth of bacteria in broth, 200 µl was transferred into a spectrophotometer reading plate and bacteria OD was read at 600 nm absorbance. All bacteria strains were then normalized to 0.05 OD utilizing PBS 1× buffer. Once desired dilutions were made, 3 µl of the bacteria solution was applied per seed, and mixed well by shaking in a sterile Falcon tube for 5-10 seconds. Control treatments were prepared by mixing equivalent volumes of PBS 1× buffer with the seeds.

Example 16: Methods of Preparing Spore Suspension Inoculum of Endophyte Strains for Seedling Vigor Assays Spore solutions are made by rinsing and scraping spores from agar slants which has been growing for about 1 month. Rinsing is done with 0.05% Silwet. Solutions are passed through Miracloth to filter out mycelia. Spores per ml are counted under microscope using a hemocytometer. The stock suspension is then diluted into $10^6$ spores/ml utilizing water. 3 µl of spore suspension is used per seed (~$10^3$ CFUs/seed is obtained). Control treatments are prepared by adding equivalent volumes of sterile water to seeds.

Example 17: Method for Measuring Root Length and Surface Area Using WinRhizo Preparation of Samples Dirt, excess water, seed coats and other debris was removed from seedlings to allow accurate scanning of the roots. Individual seedlings were laid out on clear plastic trays and trays were arranged on an Epson Expression 11000XL scanner (Epson America, Inc., Long Beach Calif.). Roots were manually arranged to reduce the amount of overlap. For root measurements, shoots were removed if the shape of the shoot caused it to overlap the roots.

Scanning with WinRHIZO

The WinRHIZO software version Arabidopsis Pro2016a (Regents Instruments, Quebec Canada) was used with the following acquisition settings: greyscale 4000 dpi image, speed priority, overlapping (1 object), Root Morphology: Precision (standard), Crossing Detection (normal). The scanning area was set to the maximum scanner area. When the scan completed, the root area was selected and root length and root surface area measured. The measurements were exported in a computer readable format such as csv or tab delimited file. Statistical analysis was performed using R (R Core Team, 2016. R: A language and environment for statistical computing. R Foundation for Statistical Computing, Vienna, Austria. R-project.org/).

Example 18: Assessment of Improved Plant Characteristics: Soybean Seedling Vigor The following procedure was used to test soybean seedlings under drought conditions as a means to select individual endophytes or combinations of endophytes that may provide benefit in the field.

Method

Seed Preparation

The lot quality of soybean seeds was first assessed by testing germination of 100 seeds. Seeds were placed, 8 seeds per petri dish, on filter paper in petri dishes, 12 mL of water was added to each plate and plates were incubated for 3 days at 24° C. The percent germination was greater than 95%. One thousand soybean seeds were then surface sterilized by co-incubation with chlorine gas in a 20×30 cm container placed in a chemical fume hood for 16 hours. Percent germination of 50 seeds, per sterilization batch, was tested as above and confirmed to be greater than 95%.

Vigor Assay

Two rolled pieces of germination paper were placed in a sterile glass gar with 50 mL sterile water, then removed when completely saturated. Then the papers were separated and inoculated seeds (as prepared in Example 15) were placed at approximately 1 cm intervals along the length of one sheet of moistened germination paper, at least 2.5 cm from the top of the paper and 3.8 cm from the edge of the paper. The second sheet of was placed on top of the seeds and the layered papers and seeds were loosely rolled into a tube. Each tube was secured with a rubber band around the middle and placed in a single sterile glass jar and covered loosely with a lid. For each treatment, three jars with 15 seeds per jar were prepared. The position of jars with the growth chamber was randomized. Jars were incubated at 60% relative humidity, and 22° C. day, 18° C. night with 12 hours light and 12 hours dark for 4 days and then the lids were removed and the jars incubated for an additional 7 days. Then the germinated seedlings were weighed and photographed and root length and root surface area scored as described in Example 17.

Statistical analysis was performed using R (R Core Team, 2016. R: A language and environment for statistical computing. R Foundation for Statistical Computing, Vienna, Austria. R-project.org/).

Results

Table 4. Fresh Mass of Soybean Seedlings (g)

Exemplified are soybean seedlings treated with combinations of endophytes and untreated controls. Column A shows the SEQ ID NO for the first member of the combination. Column B shows the microbe identifier for the first member of the combination. Column C shows the SEQ ID NO for the second member of the combination. Column D shows the microbe identifier for the second member of the combination. Columns E shows the average weight (g) of a soybean seedling treated with the combination of the first and second microbe. Column F shows the standard deviation of the weight of a soybean seedling treated with the combination of the first and second microbe. Column G shows the average weight (g) of a soybean seedling treated only with the first microbe (identified in column B). Column H shows the standard deviation of the weight of a soybean seedling treated only with the first microbe (identified in column B). Column I shows the average weight (g) of a soybean seedling treated only with the second microbe (identified in column D). Column J shows the standard deviation of the weight of a soybean seedling treated only with the second microbe (identified in column D). Column K shows the average weight of a soybean seedling treated with the combination of the first and second microbes as a percentage of the average weight of a soybean seedling treated with only the first microbe. Column L shows the average weight of a soybean seedling treated with the combination of the first and second microbes as a percentage of the average weight of a soybean seedling treated with only the second microbe.

TABLE 4

| A SEQ ID NO, MIC 1 | B MIC 1 | C SEQ ID NO, MIC 2 | D MIC 2 | E Average weight, combination (g) | F Standard deviation weight, combination (g) | G Average weight, MIC 1 (g) | H Standard deviation weight, MIC 1 (g) | I Average weight, MIC 2 (g) | J Standard deviation weight, MIC 2 (g) | K Weight, as % of MIC 1 | L Weight, as % of MIC 2 |
|---|---|---|---|---|---|---|---|---|---|---|---|
|  | Control, no microbe |  | Control, no microbe | 0.64 | 0.17 |  |  |  |  |  |  |
| 1703 | MIC-87219 | 1695 | MIC-77594 | 0.78 | 0.89 | 0.58 | 0.18 | 0.63 | 0.43 | 135.88 | 124.43 |
| 1701 | MIC-76610 | 1695 | MIC-77594 | 0.69 | 0.17 | 0.67 | 0.86 | 0.63 | 0.43 | 101.64 | 109.09 |
| 1702 | MIC-97660 | 1695 | MIC-77594 | 0.64 | 0.26 | 0.84 | 0.48 | 0.63 | 0.43 | 75.9 | 102.07 |
| 1699 | MIC-18309 | 1695 | MIC-77594 | 0.59 | 0.23 | 0.56 | 0.19 | 0.63 | 0.43 | 105.9 | 94.49 |
| 1700 | MIC-68866 | 1695 | MIC-77594 | 0.57 | 0.17 | 0.62 | 0.62 | 0.63 | 0.43 | 90.79 | 90.25 |
| 1698 | MIC-54210 | 1695 | MIC-77594 | 0.55 | 0.3 | 0.76 | 0.72 | 0.63 | 0.43 | 71.76 | 87.27 |
| 1703 | MIC-87219 | 1696 | MIC-84863 | 0.88 | 1.21 | 0.58 | 0.18 | 0.55 | 0.17 | 153.47 | 160.95 |
| 1699 | MIC-18309 | 1696 | MIC-84863 | 0.73 | 1.06 | 0.56 | 0.19 | 0.55 | 0.17 | 130.13 | 132.98 |
| 1700 | MIC-68866 | 1696 | MIC-84863 | 0.64 | 0.18 | 0.62 | 0.62 | 0.55 | 0.17 | 102.33 | 116.49 |
| 1701 | MIC-76610 | 1696 | MIC-84863 | 0.63 | 0.54 | 0.67 | 0.86 | 0.55 | 0.17 | 94.08 | 115.65 |
| 1702 | MIC-97660 | 1696 | MIC-84863 | 0.63 | 0.56 | 0.84 | 0.48 | 0.55 | 0.17 | 74.05 | 114.06 |
| 1698 | MIC-54210 | 1696 | MIC-84863 | 0.55 | 0.11 | 0.76 | 0.72 | 0.55 | 0.17 | 71.75 | 99.94 |
| 1703 | MIC-87219 | 1697 | MIC-59572 | 0.89 | 0.95 | 0.58 | 0.18 | 0.59 | 0.19 | 154.2 | 150.11 |
| 1699 | MIC-18309 | 1697 | MIC-59572 | 0.66 | 0.47 | 0.56 | 0.19 | 0.59 | 0.19 | 118.51 | 112.42 |
| 1700 | MIC-68866 | 1697 | MIC-59572 | 0.62 | 0.25 | 0.62 | 0.62 | 0.59 | 0.19 | 98.54 | 104.12 |
| 1698 | MIC-54210 | 1697 | MIC-59572 | 0.59 | 0.2 | 0.76 | 0.72 | 0.59 | 0.19 | 77.32 | 99.96 |
| 1701 | MIC-76610 | 1697 | MIC-59572 | 0.57 | 0.15 | 0.67 | 0.86 | 0.59 | 0.19 | 84.08 | 95.94 |
| 1702 | MIC-97660 | 1697 | MIC-59572 | 0.56 | 0.22 | 0.84 | 0.48 | 0.59 | 0.19 | 65.94 | 94.27 |

Table 5. Root Surface Soybean Seedlings (cm²)

Exemplified are soybean seedlings treated with combinations of endophytes and untreated controls. Column A shows the SEQ ID NO for the first member of the combination. Column B shows the microbe identifier for the first member of the combination. Column C shows the SEQ ID NO for the second member of the combination. Column D shows the microbe identifier for the second member of the combination. Columns E shows the average root surface area (cm²) of a soybean seedling treated with the combination of the first and second microbe. Column F shows the standard deviation of the root surface area of a soybean seedling treated with the combination of the first and second microbe. Column G shows the average root surface area (cm²) of a soybean seedling treated only with the first microbe (identified in column B). Column H shows the standard deviation of the root surface area of a soybean seedling treated only with the first microbe (identified in column B). Column I shows the average root surface area (cm²) of a soybean seedling treated only with the second microbe (identified in column D). Column J shows the standard deviation of the root surface area of a soybean seedling treated only with the second microbe (identified in column D). Column K shows the average root surface area of a soybean seedling treated with the combination of the first and second microbes as a percentage of the average root surface area of a soybean seedling treated with only the first microbe. Column L shows the average root surface area of a soybean seedling treated with the combination of the first and second microbes as a percentage of the average root surface area of a soybean seedling treated with only the second microbe.

TABLE 5

| A SEQ ID NO MIC 1 | B MIC 1 | C SEQ ID NO MIC 2 | D MIC 2 | E Average root surface area, combination (cm2) | F Standard deviation root surface area, combination (cm2) | G Average root surface area, MIC 1 (cm2) | H Standard deviation root surface area, MIC 1 (cm2) | I Average root surface area, MIC 2 (cm2) | J Standard deviation root surface area, MIC 2 (cm2) | K Surface area, as % of MIC 1 | L Surface area, as % of MIC 2 |
|---|---|---|---|---|---|---|---|---|---|---|---|
|  | Control, no microbe |  | Control, no microbe | 8.29 | 4.18 |  |  |  |  |  |  |
| 1702 | MIC-97660 | 1695 | MIC-77594 | 12.86 | 3.2 | 7.75 | 3.52 | 8.09 | 2.75 | 165.81 | 158.94 |
| 1699 | MIC-18309 | 1695 | MIC-77594 | 9.91 | 3.56 | 9.22 | 3.25 | 8.09 | 2.75 | 107.52 | 122.48 |
| 1700 | MIC-68866 | 1695 | MIC-77594 | 9.64 | 2.78 | 9.7 | 3.05 | 8.09 | 2.75 | 99.41 | 119.14 |
| 1701 | MIC-76610 | 1695 | MIC-77594 | 9.12 | 2.6 | 9.18 | 2.49 | 8.09 | 2.75 | 99.33 | 112.73 |
| 1698 | MIC-54210 | 1695 | MIC-77594 | 8.87 | 2.07 | 9.58 | 2.45 | 8.09 | 2.75 | 92.51 | 109.59 |
| 1703 | MIC-87219 | 1695 | MIC-77594 | 8.21 | 2.44 | 9.45 | 3.32 | 8.09 | 2.75 | 86.9 | 101.47 |
| 1702 | MIC-97660 | 1696 | MIC-84863 | 9.57 | 3.68 | 7.75 | 3.52 | 7.8 | 2.67 | 123.38 | 122.67 |
| 1701 | MIC-76610 | 1696 | MIC-84863 | 10.1 | 2.85 | 9.18 | 2.49 | 7.8 | 2.67 | 109.98 | 129.46 |
| 1703 | MIC-87219 | 1696 | MIC-84863 | 10.03 | 3.32 | 9.45 | 3.32 | 7.8 | 2.67 | 106.15 | 128.56 |
| 1700 | MIC-68866 | 1696 | MIC-84863 | 9.27 | 2.39 | 9.7 | 3.05 | 7.8 | 2.67 | 95.57 | 118.8 |
| 1698 | MIC-54210 | 1696 | MIC-84863 | 9.2 | 2.7 | 9.58 | 2.45 | 7.8 | 2.67 | 96.03 | 117.99 |
| 1699 | MIC-18309 | 1696 | MIC-84863 | 8.76 | 3.44 | 9.22 | 3.25 | 7.8 | 2.67 | 95.03 | 112.29 |
| 1702 | MIC-97660 | 1697 | MIC-59572 | 9.9 | 4.95 | 7.75 | 3.52 | 8.31 | 2.17 | 127.66 | 119.12 |
| 1700 | MIC-68866 | 1697 | MIC-59572 | 9.67 | 3.69 | 9.7 | 3.05 | 8.31 | 2.17 | 99.77 | 116.41 |
| 1698 | MIC-54210 | 1697 | MIC-59572 | 9.37 | 2.24 | 9.58 | 2.45 | 8.31 | 2.17 | 97.76 | 112.74 |
| 1699 | MIC-18309 | 1697 | MIC-59572 | 8.64 | 2.39 | 9.22 | 3.25 | 8.31 | 2.17 | 93.7 | 103.92 |

TABLE 5-continued

| A SEQ ID NO MIC 1 | B MIC 1 | C SEQ ID NO MIC 2 | D MIC 2 | E Average root surface area, combination (cm2) | F Standard deviation root surface area, combination (cm2) | G Average root surface area, MIC 1 (cm2) | H Standard deviation root surface area, MIC 1 (cm2) | I Average root surface area, MIC 2 (cm2) | J Standard deviation root surface area, MIC 2 (cm2) | K Surface area, as % of MIC 1 | L Surface area, as % of MIC 2 |
|---|---|---|---|---|---|---|---|---|---|---|---|
| 1703 | MIC-87219 | 1697 | MIC-59572 | 8.46 | 1.73 | 9.45 | 3.32 | 8.31 | 2.17 | 89.57 | 101.81 |
| 1701 | MIC-76610 | 1697 | MIC-59572 | 8.03 | 2.14 | 9.18 | 2.49 | 8.31 | 2.17 | 87.46 | 96.63 |

Table 6. Root Length Soybean Seedlings (cm)

Examplified are soybean seedlings treated with combinations of endophytes and untreated controls. Column A shows the SEQ ID NO for the first member of the combination. Column B shows the microbe identifier for the first member of the combination. Column C shows the SEQ ID NO for the second member of the combination. Column D shows the microbe identifier for the second member of the combination. Columns E shows the average root length (cm) of a soybean seedling treated with the combination of the first and second microbe. Column F shows the standard deviation of the root length of a soybean seedling treated with the combination of the first and second microbe. Column G shows the average root length (cm) of a soybean seedling treated only with the first microbe (identified in column B). Column H shows the standard deviation of the root length of a soybean seedling treated only with the first microbe (identified in column B). Column I shows the average root length (cm) of a soybean seedling treated only with the second microbe (identified in column D). Column J shows the standard deviation of the root length of a soybean seedling treated only with the second microbe (identified in column D). Column K shows the average root length of a soybean seedling treated with the combination of the first and second microbes as a percentage of the average root length of a soybean seedling treated with only the first microbe. Column L shows the average root length of a soybean seedling treated with the combination of the first and second microbes as a percentage of the average root length of a soybean seedling treated with only the second microbe.

TABLE 6

| A SEQ ID NO, MIC 1 | B MIC 1 | C SEQ ID NO, MIC 2 | D MIC 2 | E Average root length, combination (cm) | F Standard deviation root length, combination (cm) | G Average root length, MIC 1 (cm) | H Standard deviation root length, MIC 1 (cm) | I Average root length, MIC 2 (cm) | J Standard deviation root length, MIC 2 (cm) | K Root length, as % of MIC 1 | L Root length, as % of MIC 2 |
|---|---|---|---|---|---|---|---|---|---|---|---|
| | Control, no microbe | | Control, no microbe | 74.89 | 41.31 | | | | | | |
| 1699 | MIC-18309 | 1695 | MIC-77594 | 94.63 | 32.31 | 81.64 | 29.29 | 78.77 | 27.45 | 115.91 | 120.13 |
| 1702 | MIC-97660 | 1695 | MIC-77594 | 86.83 | 17.78 | 75.44 | 36.06 | 78.77 | 27.45 | 115.1 | 110.23 |
| 1700 | MIC-68866 | 1695 | MIC-77594 | 86.9 | 27.23 | 80.05 | 27.51 | 78.77 | 27.45 | 108.56 | 110.31 |
| 1701 | MIC-76610 | 1695 | MIC-77594 | 78.43 | 27.72 | 78.03 | 23.87 | 78.77 | 27.45 | 100.51 | 99.57 |
| 1703 | MIC-87219 | 1695 | MIC-77594 | 77.26 | 27.43 | 86.39 | 31.59 | 78.77 | 27.45 | 89.43 | 98.08 |
| 1698 | MIC-54210 | 1695 | MIC-77594 | 76.44 | 18.8 | 88.17 | 25.39 | 78.77 | 27.45 | 86.7 | 97.04 |
| 1702 | MIC-97660 | 1696 | MIC-84863 | 87.95 | 31.74 | 75.44 | 36.06 | 78.72 | 28.58 | 116.57 | 111.73 |
| 1701 | MIC-76610 | 1696 | MIC-84863 | 88.2 | 26.24 | 78.03 | 23.87 | 78.72 | 28.58 | 113.03 | 112.05 |
| 1703 | MIC-87219 | 1696 | MIC-84863 | 87 | 35.2 | 86.39 | 31.59 | 78.72 | 28.58 | 100.71 | 110.53 |
| 1700 | MIC-68866 | 1696 | MIC-84863 | 81.95 | 18.71 | 80.05 | 27.51 | 78.72 | 28.58 | 102.38 | 104.11 |
| 1698 | MIC-54210 | 1696 | MIC-84863 | 85.12 | 22.37 | 88.17 | 25.39 | 78.72 | 28.58 | 96.54 | 108.13 |
| 1699 | MIC-18309 | 1696 | MIC-84863 | 80.16 | 33.45 | 81.64 | 29.29 | 78.72 | 28.58 | 98.18 | 101.83 |
| 1698 | MIC-54210 | 1697 | MIC-59572 | 86.7 | 20.82 | 88.17 | 25.39 | 77.66 | 24.66 | 98.34 | 111.64 |
| 1700 | MIC-68866 | 1697 | MIC-59572 | 82.04 | 36.84 | 80.05 | 27.51 | 77.66 | 24.66 | 102.49 | 105.64 |
| 1702 | MIC-97660 | 1697 | MIC-59572 | 78.22 | 35.87 | 75.44 | 36.06 | 77.66 | 24.66 | 103.68 | 100.71 |
| 1703 | MIC-87219 | 1697 | MIC-59572 | 80.32 | 17.85 | 86.39 | 31.59 | 77.66 | 24.66 | 92.97 | 103.42 |
| 1699 | MIC-18309 | 1697 | MIC-59572 | 77.04 | 22.27 | 81.64 | 29.29 | 77.66 | 24.66 | 94.36 | 99.19 |
| 1701 | MIC-76610 | 1697 | MIC-59572 | 71.83 | 17.23 | 78.03 | 23.87 | 77.66 | 24.66 | 92.06 | 92.49 |

Example 19: Assessment of Improved Plant Characteristics: Corn Seedling Vigor

The following procedure was used to test corn seedlings under drought conditions as a means to select individual endophytes or combinations of endophytes that may provide benefit in the field.

Method

Seed Preparation

The lot quality of corn seeds was first evaluated for germination by transfer of 100 seeds and with 3.5 mL of water to a filter paper lined petri dish. Seeds were incubated for 3 days at 24° C., and percent germination was greater than 95%. One thousand corn seeds were then surface sterilized by co-incubation with chlorine gas in a 20×30 cm container in a chemical fume hood for 12 hours. Percent germination of 50 seeds, per sterilization batch, was tested as above and confirmed to be greater than 95%.

Reagent Preparation 7.5% PEG 6000 (Calbiochem, San Diego, Calif.) was prepared by adding 75 g of PEG to 1000 mL of water, then stirring on a warm hot plate until the PEG was fully dissolved. The solution was then autoclaved.
Vigor Assay 25 ml of PEG solution was added to each Cyg™ germination pouch (Mega International, Newport, Minn.) and place into pouch rack (Mega International, Newport, Minn.). Sterile forceps were used to place seeds prepared as in Example 15 into every other perforation in the germination pouch. Seeds were fitted snugly into each perforation to ensure they did not slide around when moving the pouches. Before and in between treatments forceps were sterilized using ethanol and flame and workspace wiped down with 70% ethanol. For each treatment, three pouches with 15 seeds per pouch were prepared. The germination racks with germination pouches were placed into plastic tubs, and covered with perforated plastic wrap to prevent drying. Tubs were incubated at 60% relative humidity, and 22° C. day, 18° C. night with 12 hours light and 12 hours dark for 6 days to allow for germination and root length growth. Placement of pouches within racks and racks/tubs within the growth chamber was randomized to minimize positional effect. At the end of 6 days the seeds were scored manually for germination, root and shoot length.

Statistical analysis was performed using R (R Core Team, 2016. R: A language and environment for statistical computing. R Foundation for Statistical Computing, Vienna, Austria. R-project.org/).
Results
Table 7. Germination Corn Seedlings Exemplified are corn seedlings treated with combinations of endophytes and untreated controls. Column A shows the SEQ ID NO for the first member of the combination. Column B shows the microbe identifier for the first member of the combination. Column C shows the SEQ ID NO for the second member of the combination. Column D shows the microbe identifier for the second member of the combination. Columns E shows the average percent germination of corn seedlings treated with the combination of the first and second microbe. Column F shows the average percent germination of corn seedlings treated only with the first microbe (identified in column B). Column G shows the average percent germination of corn seedlings treated only with the first microbe (identified in column B).

TABLE 7

| A SEQ ID NO, MIC 1 | B MIC 1 | C SEQ ID NO, MIC 2 | D MIC 2 | E % Germination, combination | F % Germination, MIC 1 | G % Germination, MIC 2 |
|---|---|---|---|---|---|---|
| | Control, no microbe | | Control, no microbe | 80.95 | | |
| 1698 | MIC-54210 | 1695 | MIC-77594 | 85.71 | 73.81 | 71.43 |
| 1699 | MIC-18309 | 1695 | MIC-77594 | 76.19 | 85.71 | 71.43 |
| 1700 | MIC-68866 | 1695 | MIC-77594 | 90.48 | 73.81 | 71.43 |
| 1701 | MIC-76610 | 1695 | MIC-77594 | 71.43 | 90.48 | 71.43 |
| 1702 | MIC-97660 | 1695 | MIC-77594 | 80.95 | 76.19 | 71.43 |
| 1703 | MIC-87219 | 1695 | MIC-77594 | 59.52 | 66.67 | 71.43 |
| 1698 | MIC-54210 | 1696 | MIC-84863 | 76.19 | 73.81 | 80.95 |
| 1699 | MIC-18309 | 1696 | MIC-84863 | 66.67 | 85.71 | 80.95 |
| 1700 | MIC-68866 | 1696 | MIC-84863 | 80.95 | 73.81 | 80.95 |
| 1701 | MIC-76610 | 1696 | MIC-84863 | 61.9 | 90.48 | 80.95 |
| 1702 | MIC-97660 | 1696 | MIC-84863 | 88.1 | 76.19 | 80.95 |
| 1703 | MIC-87219 | 1696 | MIC-84863 | 76.19 | 66.67 | 80.95 |
| 1698 | MIC-54210 | 1697 | MIC-59572 | 88.1 | 73.81 | 64.29 |
| 1699 | MIC-18309 | 1697 | MIC-59572 | 73.81 | 85.71 | 64.29 |
| 1700 | MIC-68866 | 1697 | MIC-59572 | 73.81 | 73.81 | 64.29 |
| 1701 | MIC-76610 | 1697 | MIC-59572 | 64.29 | 90.48 | 64.29 |
| 1702 | MIC-97660 | 1697 | MIC-59572 | 85.71 | 76.19 | 64.29 |
| 1703 | MIC-87219 | 1697 | MIC-59572 | 73.81 | 66.67 | 64.29 |

Table 8. Shoot Length Corn Seedlings (cm)

Exemplified are corn seedlings treated with combinations of endophytes and untreated controls. Column A shows the SEQ ID NO for the first member of the combination. Column B shows the microbe identifier for the first member of the combination. Column C shows the SEQ ID NO for the second member of the combination. Column D shows the microbe identifier for the second member of the combination. Columns E shows the average shoot length (cm) of a corn seedling treated with the combination of the first and second microbe. Column F shows the standard deviation of the shoot length of a corn seedling treated with the combination of the first and second microbe. Column G shows the average shoot length (cm) of a corn seedling treated only with the first microbe (identified in column B). Column H shows the standard deviation of the shoot length of a corn seedling treated only with the first microbe (identified in column B). Column I shows the average shoot length (cm) of a corn seedling treated only with the second microbe (identified in column D). Column J shows the standard deviation of the shoot length of a corn seedling treated only with the second microbe (identified in column D). Column K shows the average shoot length of a corn seedling treated with the combination of the first and second microbes as a percentage of the average shoot length of a corn seedling treated with only the first microbe. Column L shows the average shoot length of a corn seedling treated with the combination of the first and second microbes as a percentage of the average shoot length of a corn seedling treated with only the second microbe.

TABLE 8

| A SEQ ID NO, MIC 1 | B MIC 1 | C SEQ ID NO, MIC 2 | D MIC 2 | E Average shoot length, combination (cm) | F Standard deviation shoot length, combination (cm) | G Average shoot length, MIC 1 (cm) | H Standard deviation shoot length, MIC 1 (cm) | I Average shoot length, MIC 2 (cm) | J Standard deviation shoot length, MIC 2 (cm) | K Shoot length, as % of MIC 1 | L Shoot length, as % of MIC 2 |
|---|---|---|---|---|---|---|---|---|---|---|---|
|  | Control, no microbe |  | Control, no microbe | 0.41 | 0.93 |  |  |  |  |  |  |
| 1703 | MIC-87219 | 1695 | MIC-77594 | 0.97 | 1.75 | 0.82 | 1.44 | 0.42 | 0.71 | 117.8 | 229.76 |
| 1701 | MIC-76610 | 1695 | MIC-77594 | 0.41 | 0.71 | 0.33 | 0.57 | 0.42 | 0.71 | 123.09 | 95.93 |
| 1698 | MIC-54210 | 1695 | MIC-77594 | 0.55 | 0.92 | 1 | 1.54 | 0.42 | 0.71 | 55.46 | 131.26 |
| 1699 | MIC-18309 | 1695 | MIC-77594 | 0.34 | 0.76 | 0.41 | 1.38 | 0.42 | 0.71 | 82.65 | 80.96 |
| 1700 | MIC-68866 | 1695 | MIC-77594 | 0.26 | 0.67 | 0.27 | 0.92 | 0.42 | 0.71 | 95.05 | 61.16 |
| 1702 | MIC-97660 | 1695 | MIC-77594 | 0.25 | 0.61 | 0.31 | 0.64 | 0.42 | 0.71 | 79.41 | 59.07 |
| 1699 | MIC-18309 | 1696 | MIC-84863 | 0.47 | 0.88 | 0.41 | 1.38 | 0.57 | 1.1 | 113.09 | 81.84 |
| 1701 | MIC-76610 | 1696 | MIC-84863 | 0.4 | 1.02 | 0.33 | 0.57 | 0.57 | 1.1 | 122.75 | 70.68 |
| 1702 | MIC-97660 | 1696 | MIC-84863 | 0.37 | 0.77 | 0.31 | 0.64 | 0.57 | 1.1 | 118.41 | 65.07 |
| 1703 | MIC-87219 | 1696 | MIC-84863 | 0.52 | 0.92 | 0.82 | 1.44 | 0.57 | 1.1 | 63.27 | 91.17 |
| 1698 | MIC-54210 | 1696 | MIC-84863 | 0.45 | 1 | 1 | 1.54 | 0.57 | 1.1 | 44.65 | 78.07 |
| 1700 | MIC-68866 | 1696 | MIC-84863 | 0.21 | 0.57 | 0.27 | 0.92 | 0.57 | 1.1 | 76.04 | 36.15 |
| 1701 | MIC-76610 | 1697 | MIC-59572 | 0.97 | 1.47 | 0.33 | 0.57 | 0.38 | 0.85 | 296.07 | 255.02 |
| 1702 | MIC-97660 | 1697 | MIC-59572 | 0.48 | 0.89 | 0.31 | 0.64 | 0.38 | 0.85 | 153.98 | 126.58 |
| 1703 | MIC-87219 | 1697 | MIC-59572 | 0.55 | 1.22 | 0.82 | 1.44 | 0.38 | 0.85 | 67.13 | 144.69 |
| 1699 | MIC-18309 | 1697 | MIC-59572 | 0.42 | 1.32 | 0.41 | 1.38 | 0.38 | 0.85 | 101.59 | 109.97 |
| 1698 | MIC-54210 | 1697 | MIC-59572 | 0.26 | 0.62 | 1 | 1.54 | 0.38 | 0.85 | 26.25 | 68.65 |
| 1700 | MIC-68866 | 1697 | MIC-59572 | 0.05 | 0.28 | 0.27 | 0.92 | 0.38 | 0.85 | 18.73 | 13.32 |

Table 9. Root Length Corn Seedlings (cm)

Exemplified are corn seedlings treated with combinations of endophytes and untreated controls. Column A shows the SEQ ID NO for the first member of the combination. Column B shows the microbe identifier for the first member of the combination. Column C shows the SEQ ID NO for the second member of the combination. Column D shows the microbe identifier for the second member of the combination. Columns E shows the average root length (cm) of a corn seedling treated with the combination of the first and second microbe. Column F shows the standard deviation of the root length of a corn seedling treated with the combination of the first and second microbe. Column G shows the average root length (cm) of a corn seedling treated only with the first microbe (identified in column B). Column H shows the standard deviation of the root length of a corn seedling treated only with the first microbe (identified in column B). Column I shows the average root length (cm) of a corn seedling treated only with the second microbe (identified in column D). Column J shows the standard deviation of the root length of a corn seedling treated only with the second microbe (identified in column D). Column K shows the average root length of a corn seedling treated with the combination of the first and second microbes as a percentage of the average root length of a corn seedling treated with only the first microbe. Column L shows the average root length of a corn seedling treated with the combination of the first and second microbes as a percentage of the average root length of a corn seedling treated with only the second microbe.

TABLE 9

| A SEQ ID NO, MIC 1 | B MIC 1 | C SEQ ID NO, MIC 2 | D MIC 2 | E Average root length, combination (cm) | F Standard deviation root length, combination (cm) | G Average root length, MIC 1 (cm) | H Standard deviation root length, MIC 1 (cm) | I Average root length, MIC 2 (cm) | J Standard deviation root length, MIC 2 (cm) | K Root length, as % of MIC 1 | L Root length, as % of MIC 2 |
|---|---|---|---|---|---|---|---|---|---|---|---|
|  | Control, no microbe |  | Control, no microbe | 11.88 | 3.85 |  |  |  |  |  |  |
| 1698 | MIC-54210 | 1695 | MIC-77594 | 13.87 | 2.08 | 12.46 | 2.78 | 10.95 | 3.7 | 111.31 | 126.7 |
| 1700 | MIC-68866 | 1695 | MIC-77594 | 12.65 | 1.9 | 10.59 | 3.24 | 10.95 | 3.7 | 119.52 | 115.57 |
| 1702 | MIC-97660 | 1695 | MIC-77594 | 10.34 | 3.23 | 8.86 | 3.52 | 10.95 | 3.7 | 116.73 | 94.47 |
| 1701 | MIC-76610 | 1695 | MIC-77594 | 11.32 | 3.25 | 10.56 | 4.41 | 10.95 | 3.7 | 107.2 | 103.42 |
| 1703 | MIC-87219 | 1695 | MIC-77594 | 10.43 | 3.87 | 10.72 | 3.29 | 10.95 | 3.7 | 97.31 | 95.26 |
| 1699 | MIC-18309 | 1695 | MIC-77594 | 10.14 | 3.42 | 10.55 | 3.11 | 10.95 | 3.7 | 96.04 | 92.58 |
| 1699 | MIC-18309 | 1696 | MIC-84863 | 11.69 | 2.98 | 10.55 | 3.11 | 10.02 | 5.12 | 110.77 | 116.68 |
| 1703 | MIC-87219 | 1696 | MIC-84863 | 11.61 | 3.18 | 10.72 | 3.29 | 10.02 | 5.12 | 108.34 | 115.9 |
| 1702 | MIC-97660 | 1696 | MIC-84863 | 10.18 | 2.1 | 8.86 | 3.52 | 10.02 | 5.12 | 114.92 | 101.63 |
| 1698 | MIC-54210 | 1696 | MIC-84863 | 11.99 | 3.52 | 12.46 | 2.78 | 10.02 | 5.12 | 96.17 | 119.62 |
| 1700 | MIC-68866 | 1696 | MIC-84863 | 10.63 | 3.77 | 10.59 | 3.24 | 10.02 | 5.12 | 100.37 | 106.06 |
| 1701 | MIC-76610 | 1696 | MIC-84863 | 9.58 | 3.77 | 10.56 | 4.41 | 10.02 | 5.12 | 90.72 | 95.65 |
| 1702 | MIC-97660 | 1697 | MIC-59572 | 11.37 | 3.69 | 8.86 | 3.52 | 10.7 | 3.9 | 128.27 | 106.18 |
| 1700 | MIC-68866 | 1697 | MIC-59572 | 11.6 | 3 | 10.59 | 3.24 | 10.7 | 3.9 | 109.58 | 108.38 |
| 1703 | MIC-87219 | 1697 | MIC-59572 | 11.18 | 2.98 | 10.72 | 3.29 | 10.7 | 3.9 | 104.33 | 104.47 |
| 1701 | MIC-76610 | 1697 | MIC-59572 | 10.7 | 4.1 | 10.56 | 4.41 | 10.7 | 3.9 | 101.34 | 100 |

TABLE 9-continued

| A SEQ ID NO, MIC 1 | B MIC 1 | C SEQ ID NO, MIC 2 | D MIC 2 | E Average root length, combination (cm) | F Standard deviation root length, combination (cm) | G Average root length, MIC 1 (cm) | H Standard deviation root length, MIC 1 (cm) | I Average root length, MIC 2 (cm) | J Standard deviation root length, MIC 2 (cm) | K Root length, as % of MIC 1 | L Root length, as % of MIC 2 |
|---|---|---|---|---|---|---|---|---|---|---|---|
| 1699 | MIC-18309 | 1697 | MIC-59572 | 9.31 | 3.69 | 10.55 | 3.11 | 10.7 | 3.9 | 88.18 | 86.94 |
| 1698 | MIC-54210 | 1697 | MIC-59572 | 8.46 | 3.52 | 12.46 | 2.78 | 10.7 | 3.9 | 67.85 | 79 |

Table 10: Pairs of Endophytes Useful for the Present Invention, as Identified by Co-Occurrence Analysis of Various Plant Samples.

Column A shows the pair number. Columns B and C show the SEQ ID NO: and OTU designation for endophyte 1 of a pair. Columns D and E show the SEQ ID NO: and OTU designation for endophyte 2 of a pair. Columns F, G, and H show the number of times microbes belonging to OTU1 occur in a sample (N1), the number of times microbes belonging to OTU2 occur in a sample (N2), the number of times the microbes co-occur in all the plant samples of the collection or a subgroup of those plant samples (OC), and the number of times microbes of those OTUs would be expected to co-occur (EC). In this table, "Bacteria—all" represent a co-occurrence analysis using all of the plant samples of the collection, to identify bacteria that co-occur in these samples. "Bacteria—roots" represent a co-occurrence analysis of community sequencing data obtained from roots samples only, to identify bacteria that co-occur in these samples. "Bacteria—seeds" represent a co-occurrence analysis of community sequencing data obtained from seed samples only, to identify bacteria that co-occur in these samples.

TABLE 10

| A PAIR | B Endophyte 1 (SEQ ID NO:) | C Endophyte 1 (OTU) | D Endophyte 2 (SEQ ID NO:) | E Endophyte 2 (OTU) | F Bacteria - all | | | | G Bacteria - roots | | | | H Bacteria - seeds | | | |
|---|---|---|---|---|---|---|---|---|---|---|---|---|---|---|---|---|
| | | | | | N1 | N2 | OC | EC | N1 | N2 | OC | EC | N1 | N2 | OC | EC |
| 1 | 1108 | B1.0|REF97__V4|1 | 1110 | B1.0|REF99__V4|108549 | 68 | 55 | 45 | 12 | | | | | 49 | 55 | 45 | 12 |
| 2 | 1108 | B1.0|REF97__V4|1 | 1080 | B1.0|REF99__V4|19 | 68 | 67 | 50 | 15 | | | | | 49 | 61 | 44 | 13 |
| 3 | 1108 | B1.0|REF97__V4|1 | 1093 | B1.0|REF99__V4|29 | 68 | 69 | 50 | 15 | | | | | 49 | 64 | 45 | 14 |
| 4 | 137 | B1.0|REF97__V4|11 | 974 | B1.0|REF97__V4|2831 | 63 | 79 | 51 | 16 | | | | | | | | |
| 5 | 137 | B1.0|REF97__V4|11 | 916 | B1.0|REF97__V4|3675 | 63 | 70 | 47 | 14 | | | | | | | | |
| 6 | 137 | B1.0|REF97__V4|11 | 137 | B1.0|REF99__V4|11 | 63 | 119 | 61 | 25 | | | | | | | | |
| 7 | 137 | B1.0|REF97__V4|11 | 71 | B1.0|REF99__V4|1351 | 63 | 70 | 45 | 14 | | | | | | | | |
| 8 | 137 | B1.0|REF97__V4|11 | 789 | B1.0|REF99__V4|2172 | 63 | 97 | 51 | 20 | | | | | | | | |
| 9 | 137 | B1.0|REF97__V4|11 | 974 | B1.0|REF99__V4|2831 | 63 | 79 | 51 | 16 | | | | | | | | |
| 10 | 137 | B1.0|REF97__V4|11 | 916 | B1.0|REF99__V4|3675 | 63 | 77 | 50 | 16 | | | | | | | | |
| 11 | 137 | B1.0|REF97__V4|11 | 1012 | B1.0|REF99__V4|597 | 63 | 73 | 47 | 15 | | | | | | | | |
| 12 | 137 | B1.0|REF97__V4|11 | 1007 | B1.0|REF99__V4|9526 | 63 | 83 | 49 | 17 | | | | | | | | |
| 13 | 1089 | B1.0|REF97__V4|127 | 1095 | B1.0|REF99__V4|54497 | 135 | 93 | 84 | 41 | | | | | 98 | 93 | 84 | 40 |
| 14 | 1191 | B1.0|REF97__V4|150716 | 111 | B1.0|REF99__V4|1256 | 81 | 67 | 50 | 18 | | | | | 81 | 67 | 50 | 24 |
| 15 | 1191 | B1.0|REF97__V4|150716 | 1191 | B1.0|REF99__V4|150716 | 81 | 87 | 75 | 23 | | | | | 81 | 86 | 75 | 31 |
| 16 | 1191 | B1.0|REF97__V4|150716 | 972 | B1.0|REF99__V4|218 | 81 | 99 | 64 | 26 | | | | | 81 | 99 | 64 | 35 |
| 17 | 1191 | B1.0|REF97__V4|150716 | 957 | B1.0|REF99__V4|921 | 81 | 95 | 60 | 25 | | | | | 81 | 80 | 60 | 29 |
| 18 | 1011 | B1.0|REF97__V4|2104 | 974 | B1.0|REF97__V4|2831 | 51 | 79 | 51 | 13 | | | | | | | | |
| 19 | 1011 | B1.0|REF97__V4|2104 | 916 | B1.0|REF97__V4|3675 | 51 | 70 | 47 | 12 | | | | | | | | |
| 20 | 1011 | B1.0|REF97__V4|2104 | 959 | B1.0|REF99__V4|126 | 51 | 71 | 48 | 12 | | | | | | | | |
| 21 | 1011 | B1.0|REF97__V4|2104 | 1011 | B1.0|REF99__V4|2104 | 51 | 62 | 45 | 10 | | | | | | | | |
| 22 | 1011 | B1.0|REF97__V4|2104 | 789 | B1.0|REF99__V4|2172 | 51 | 97 | 48 | 16 | | | | | | | | |
| 23 | 1011 | B1.0|REF97__V4|2104 | 974 | B1.0|REF99__V4|2831 | 51 | 79 | 51 | 13 | | | | | | | | |
| 24 | 1011 | B1.0|REF97__V4|2104 | 916 | B1.0|REF99__V4|3675 | 51 | 77 | 50 | 13 | | | | | | | | |
| 25 | 1011 | B1.0|REF97__V4|2104 | 1012 | B1.0|REF99__V4|597 | 51 | 73 | 47 | 12 | | | | | | | | |
| 26 | 1011 | B1.0|REF97__V4|2104 | 713 | B1.0|REF99__V4|754 | 51 | 76 | 45 | 13 | | | | | | | | |
| 27 | 1011 | B1.0|REF97__V4|2104 | 915 | B1.0|REF99__V4|884 | 51 | 55 | 40 | 9 | | | | | | | | |
| 28 | 1011 | B1.0|REF97__V4|2104 | 1007 | B1.0|REF99__V4|9526 | 51 | 83 | 46 | 14 | | | | | | | | |
| 29 | 974 | B1.0|REF97__V4|2831 | 615 | B1.0|REF97__V4|3374 | 79 | 45 | 45 | 12 | | | | | | | | |
| 30 | 974 | B1.0|REF97__V4|2831 | 916 | B1.0|REF97__V4|3675 | 79 | 70 | 70 | 18 | | | | | | | | |
| 31 | 974 | B1.0|REF97__V4|2831 | 837 | B1.0|REF97__V4|720 | 79 | 75 | 66 | 19 | | | | | | | | |
| 32 | 974 | B1.0|REF97__V4|2831 | 1007 | B1.0|REF99__V4|9526 | 79 | 54 | 52 | 14 | | | | | | | | |
| 33 | 974 | B1.0|REF97__V4|2831 | 137 | B1.0|REF99__V4|11 | 79 | 119 | 78 | 31 | | | | | | | | |
| 34 | 974 | B1.0|REF97__V4|2831 | 884 | B1.0|REF99__V4|1164 | 79 | 54 | 54 | 14 | | | | | | | | |
| 35 | 974 | B1.0|REF97__V4|2831 | 959 | B1.0|REF99__V4|126 | 79 | 71 | 71 | 18 | | | | | | | | |
| 36 | 974 | B1.0|REF97__V4|2831 | 886 | B1.0|REF99__V4|1287 | 79 | 44 | 43 | 11 | | | | | | | | |
| 37 | 974 | B1.0|REF97__V4|2831 | 71 | B1.0|REF99__V4|1351 | 79 | 70 | 68 | 18 | | | | | | | | |
| 38 | 974 | B1.0|REF97__V4|2831 | 648 | B1.0|REF99__V4|14 | 79 | 171 | 79 | 44 | | | | | | | | |
| 39 | 974 | B1.0|REF97__V4|2831 | 739 | B1.0|REF99__V4|1562 | 79 | 51 | 45 | 13 | | | | | | | | |
| 40 | 974 | B1.0|REF97__V4|2831 | 116 | B1.0|REF99__V4|1567 | 79 | 68 | 61 | 18 | | | | | | | | |
| 41 | 974 | B1.0|REF97__V4|2831 | 1171 | B1.0|REF99__V4|1639 | 79 | 43 | 43 | 11 | | | | | | | | |
| 42 | 974 | B1.0|REF97__V4|2831 | 1180 | B1.0|REF99__V4|166 | 79 | 101 | 59 | 26 | | | | | | | | |

TABLE 10-continued

| A PAIR | B Endophyte 1 (SEQ ID NO:) | C Endophyte 1 (OTU) | D Endophyte 2 (SEQ ID NO:) | E Endophyte 2 (OTU) | F Bacteria - all | | | | G Bacteria - roots | | | | H Bacteria - seeds | | | |
|---|---|---|---|---|---|---|---|---|---|---|---|---|---|---|---|---|
| | | | | | N1 | N2 | OC | EC | N1 | N2 | OC | EC | N1 | N2 | OC | EC |
| 43 | 974 | B1.0|REF97_V4|2831 | 889 | B1.0|REF99_V4|185 | 79 | 63 | 50 | 16 | | | | | | | | |
| 44 | 974 | B1.0|REF97_V4|2831 | 656 | B1.0|REF99_V4|191 | 79 | 81 | 57 | 21 | | | | | | | | |
| 45 | 974 | B1.0|REF97_V4|2831 | 1011 | B1.0|REF99_V4|2104 | 79 | 62 | 62 | 16 | | | | | | | | |
| 46 | 974 | B1.0|REF97_V4|2831 | 789 | B1.0|REF99_V4|2172 | 79 | 97 | 74 | 25 | | | | | | | | |
| 47 | 974 | B1.0|REF97_V4|2831 | 683 | B1.0|REF99_V4|2385 | 79 | 42 | 42 | 11 | | | | | | | | |
| 48 | 974 | B1.0|REF97_V4|2831 | 810 | B1.0|REF99_V4|250 | 79 | 61 | 61 | 16 | | | | | | | | |
| 49 | 974 | B1.0|REF97_V4|2831 | 131 | B1.0|REF99_V4|251 | 79 | 63 | 53 | 16 | | | | | | | | |
| 50 | 974 | B1.0|REF97_V4|2831 | 943 | B1.0|REF99_V4|26030 | 79 | 63 | 63 | 16 | | | | | | | | |
| 51 | 974 | B1.0|REF97_V4|2831 | 974 | B1.0|REF99_V4|2831 | 79 | 79 | 79 | 20 | | | | | | | | |
| 52 | 974 | B1.0|REF97_V4|2831 | 615 | B1.0|REF99_V4|3374 | 79 | 64 | 64 | 17 | | | | | | | | |
| 53 | 974 | B1.0|REF97_V4|2831 | 963 | B1.0|REF99_V4|33855 | 79 | 58 | 54 | 15 | | | | | | | | |
| 54 | 974 | B1.0|REF97_V4|2831 | 961 | B1.0|REF99_V4|3580 | 79 | 42 | 42 | 11 | | | | | | | | |
| 55 | 974 | B1.0|REF97_V4|2831 | 916 | B1.0|REF99_V4|3675 | 79 | 77 | 77 | 20 | | | | | | | | |
| 56 | 974 | B1.0|REF97_V4|2831 | 945 | B1.0|REF99_V4|442 | 79 | 46 | 46 | 12 | | | | | | | | |
| 57 | 974 | B1.0|REF97_V4|2831 | 880 | B1.0|REF99_V4|472 | 79 | 66 | 57 | 17 | | | | | | | | |
| 58 | 974 | B1.0|REF97_V4|2831 | 69 | B1.0|REF99_V4|506 | 79 | 58 | 56 | 15 | | | | | | | | |
| 59 | 974 | B1.0|REF97_V4|2831 | 60 | B1.0|REF99_V4|514 | 79 | 42 | 42 | 11 | | | | | | | | |
| 60 | 974 | B1.0|REF97_V4|2831 | 1012 | B1.0|REF99_V4|597 | 79 | 73 | 73 | 19 | | | | | | | | |
| 61 | 974 | B1.0|REF97_V4|2831 | 319 | B1.0|REF99_V4|70731 | 79 | 45 | 45 | 12 | | | | | | | | |
| 62 | 974 | B1.0|REF97_V4|2831 | 837 | B1.0|REF99_V4|720 | 79 | 125 | 79 | 32 | | | | | | | | |
| 63 | 974 | B1.0|REF97_V4|2831 | 713 | B1.0|REF99_V4|754 | 79 | 76 | 65 | 20 | | | | | | | | |
| 64 | 974 | B1.0|REF97_V4|2831 | 915 | B1.0|REF99_V4|884 | 79 | 55 | 55 | 14 | | | | | | | | |
| 65 | 974 | B1.0|REF97_V4|2831 | 1007 | B1.0|REF99_V4|9526 | 79 | 83 | 72 | 21 | | | | | | | | |
| 66 | 615 | B1.0|REF97_V4|3374 | 959 | B1.0|REF99_V4|126 | 45 | 71 | 42 | 10 | | | | | | | | |
| 67 | 615 | B1.0|REF97_V4|3374 | 71 | B1.0|REF99_V4|1351 | 45 | 70 | 41 | 10 | | | | | | | | |
| 68 | 615 | B1.0|REF97_V4|3374 | 1011 | B1.0|REF99_V4|2104 | 45 | 62 | 41 | 9 | | | | | | | | |
| 69 | 615 | B1.0|REF97_V4|3374 | 974 | B1.0|REF99_V4|2831 | 45 | 79 | 45 | 12 | | | | | | | | |
| 70 | 615 | B1.0|REF97_V4|3374 | 615 | B1.0|REF99_V4|3374 | 45 | 64 | 43 | 9 | | | | | | | | |
| 71 | 615 | B1.0|REF97_V4|3374 | 916 | B1.0|REF99_V4|3675 | 45 | 77 | 45 | 11 | | | | | | | | |
| 72 | 615 | B1.0|REF97_V4|3374 | 1012 | B1.0|REF99_V4|597 | 45 | 73 | 43 | 11 | | | | | | | | |
| 73 | 615 | B1.0|REF97_V4|3374 | 1007 | B1.0|REF99_V4|9526 | 45 | 83 | 43 | 12 | | | | | | | | |
| 74 | 916 | B1.0|REF97_V4|3675 | 837 | B1.0|REF97_V4|720 | 70 | 75 | 58 | 17 | | | | | | | | |
| 75 | 916 | B1.0|REF97_V4|3675 | 1007 | B1.0|REF97_V4|9526 | 70 | 54 | 49 | 12 | | | | | | | | |
| 76 | 916 | B1.0|REF97_V4|3675 | 137 | B1.0|REF99_V4|11 | 70 | 119 | 69 | 27 | | | | | | | | |
| 77 | 916 | B1.0|REF97_V4|3675 | 884 | B1.0|REF99_V4|1164 | 70 | 54 | 48 | 12 | | | | | | | | |
| 78 | 916 | B1.0|REF97_V4|3675 | 959 | B1.0|REF99_V4|126 | 70 | 71 | 63 | 16 | | | | | | | | |
| 79 | 916 | B1.0|REF97_V4|3675 | 886 | B1.0|REF99_V4|1287 | 70 | 44 | 41 | 10 | | | | | | | | |
| 80 | 916 | B1.0|REF97_V4|3675 | 71 | B1.0|REF99_V4|1351 | 70 | 70 | 60 | 16 | | | | | | | | |
| 81 | 916 | B1.0|REF97_V4|3675 | 648 | B1.0|REF99_V4|14 | 70 | 171 | 70 | 39 | | | | | | | | |
| 82 | 916 | B1.0|REF97_V4|3675 | 116 | B1.0|REF99_V4|1567 | 70 | 68 | 56 | 16 | | | | | | | | |
| 83 | 916 | B1.0|REF97_V4|3675 | 1171 | B1.0|REF99_V4|1639 | 70 | 43 | 41 | 10 | | | | | | | | |
| 84 | 916 | B1.0|REF97_V4|3675 | 656 | B1.0|REF99_V4|191 | 70 | 81 | 50 | 19 | | | | | | | | |
| 85 | 916 | B1.0|REF97_V4|3675 | 1011 | B1.0|REF99_V4|2104 | 70 | 62 | 57 | 14 | | | | | | | | |
| 86 | 916 | B1.0|REF97_V4|3675 | 789 | B1.0|REF99_V4|2172 | 70 | 97 | 66 | 22 | | | | | | | | |
| 87 | 916 | B1.0|REF97_V4|3675 | 810 | B1.0|REF99_V4|250 | 70 | 61 | 53 | 14 | | | | | | | | |
| 88 | 916 | B1.0|REF97_V4|3675 | 131 | B1.0|REF99_V4|251 | 70 | 63 | 47 | 14 | | | | | | | | |
| 89 | 916 | B1.0|REF97_V4|3675 | 943 | B1.0|REF99_V4|26030 | 70 | 63 | 60 | 14 | | | | | | | | |
| 90 | 916 | B1.0|REF97_V4|3675 | 974 | B1.0|REF99_V4|2831 | 70 | 79 | 70 | 18 | | | | | | | | |
| 91 | 916 | B1.0|REF97_V4|3675 | 615 | B1.0|REF99_V4|3374 | 70 | 64 | 56 | 15 | | | | | | | | |
| 92 | 916 | B1.0|REF97_V4|3675 | 963 | B1.0|REF99_V4|33855 | 70 | 58 | 49 | 13 | | | | | | | | |
| 93 | 916 | B1.0|REF97_V4|3675 | 916 | B1.0|REF99_V4|3675 | 70 | 77 | 70 | 18 | | | | | | | | |
| 94 | 916 | B1.0|REF97_V4|3675 | 945 | B1.0|REF99_V4|442 | 70 | 46 | 43 | 11 | | | | | | | | |
| 95 | 916 | B1.0|REF97_V4|3675 | 880 | B1.0|REF99_V4|472 | 70 | 66 | 51 | 15 | | | | | | | | |
| 96 | 916 | B1.0|REF97_V4|3675 | 69 | B1.0|REF99_V4|506 | 70 | 58 | 48 | 13 | | | | | | | | |
| 97 | 916 | B1.0|REF97_V4|3675 | 1012 | B1.0|REF99_V4|597 | 70 | 73 | 64 | 17 | | | | | | | | |
| 98 | 916 | B1.0|REF97_V4|3675 | 319 | B1.0|REF99_V4|70731 | 70 | 45 | 42 | 10 | | | | | | | | |
| 99 | 916 | B1.0|REF97_V4|3675 | 837 | B1.0|REF99_V4|720 | 70 | 125 | 70 | 29 | | | | | | | | |
| 100 | 916 | B1.0|REF97_V4|3675 | 713 | B1.0|REF99_V4|754 | 70 | 76 | 57 | 17 | | | | | | | | |
| 101 | 916 | B1.0|REF97_V4|3675 | 915 | B1.0|REF99_V4|884 | 70 | 55 | 47 | 13 | | | | | | | | |
| 102 | 916 | B1.0|REF97_V4|3675 | 1007 | B1.0|REF99_V4|9526 | 70 | 83 | 64 | 19 | | | | | | | | |
| 103 | 1106 | B1.0|REF97_V4|66 | 1094 | B1.0|REF99_V4|387 | 128 | 91 | 73 | 38 | | | | | 75 | 73 | 55 | 24 |
| 104 | 1106 | B1.0|REF97_V4|66 | 1090 | B1.0|REF99_V4|79117 | 128 | 99 | 89 | 41 | | | | | 75 | 74 | 64 | 24 |
| 105 | 837 | B1.0|REF97_V4|720 | 1007 | B1.0|REF97_V4|9526 | 75 | 54 | 45 | 13 | | | | | | | | |
| 106 | 837 | B1.0|REF97_V4|720 | 137 | B1.0|REF99_V4|11 | 75 | 119 | 66 | 29 | | | | | | | | |
| 107 | 837 | B1.0|REF97_V4|720 | 884 | B1.0|REF99_V4|1164 | 75 | 54 | 48 | 13 | | | | | | | | |
| 108 | 837 | B1.0|REF97_V4|720 | 959 | B1.0|REF99_V4|126 | 75 | 71 | 58 | 17 | | | | | | | | |
| 109 | 837 | B1.0|REF97_V4|720 | 71 | B1.0|REF99_V4|1351 | 75 | 70 | 55 | 17 | | | | | | | | |
| 110 | 837 | B1.0|REF97_V4|720 | 116 | B1.0|REF99_V4|1567 | 75 | 68 | 49 | 17 | | | | | | | | |
| 111 | 837 | B1.0|REF97_V4|720 | 1011 | B1.0|REF99_V4|2104 | 75 | 62 | 51 | 15 | | | | | | | | |
| 112 | 837 | B1.0|REF97_V4|720 | 789 | B1.0|REF99_V4|2172 | 75 | 97 | 64 | 24 | | | | | | | | |
| 113 | 837 | B1.0|REF97_V4|720 | 810 | B1.0|REF99_V4|250 | 75 | 61 | 54 | 15 | | | | | | | | |
| 114 | 837 | B1.0|REF97_V4|720 | 943 | B1.0|REF99_V4|26030 | 75 | 63 | 52 | 15 | | | | | | | | |
| 115 | 837 | B1.0|REF97_V4|720 | 974 | B1.0|REF99_V4|2831 | 75 | 79 | 66 | 19 | | | | | | | | |

TABLE 10-continued

| A PAIR | B Endophyte 1 (SEQ ID NO:) | C Endophyte 1 (OTU) | D Endophyte 2 (SEQ ID NO:) | E Endophyte 2 (OTU) | F Bacteria - all | | | | G Bacteria - roots | | | | H Bacteria - seeds | | | |
|---|---|---|---|---|---|---|---|---|---|---|---|---|---|---|---|---|
| | | | | | N1 | N2 | OC | EC | N1 | N2 | OC | EC | N1 | N2 | OC | EC |
| 116 | 837 | B1.0\|REF97__V4\|720 | 615 | B1.0\|REF99__V4\|3374 | 75 | 64 | 53 | 16 | | | | | | | | |
| 117 | 837 | B1.0\|REF97__V4\|720 | 963 | B1.0\|REF99__V4\|33855 | 75 | 58 | 47 | 14 | | | | | | | | |
| 118 | 837 | B1.0\|REF97__V4\|720 | 916 | B1.0\|REF99__V4\|3675 | 75 | 77 | 64 | 19 | | | | | | | | |
| 119 | 837 | B1.0\|REF97__V4\|720 | 880 | B1.0\|REF99__V4\|472 | 75 | 66 | 50 | 16 | | | | | | | | |
| 120 | 837 | B1.0\|REF97__V4\|720 | 1012 | B1.0\|REF99__V4\|597 | 75 | 73 | 61 | 18 | | | | | | | | |
| 121 | 837 | B1.0\|REF97__V4\|720 | 837 | B1.0\|REF99__V4\|720 | 75 | 125 | 75 | 31 | | | | | | | | |
| 122 | 837 | B1.0\|REF97__V4\|720 | 713 | B1.0\|REF99__V4\|754 | 75 | 76 | 52 | 19 | | | | | | | | |
| 123 | 837 | B1.0\|REF97__V4\|720 | 915 | B1.0\|REF99__V4\|884 | 75 | 55 | 45 | 14 | | | | | | | | |
| 124 | 837 | B1.0\|REF97__V4\|720 | 1007 | B1.0\|REF99__V4\|9526 | 75 | 83 | 61 | 20 | | | | | | | | |
| 125 | 510 | B1.0\|REF97__V4\|8981 | 510 | B1.0\|REF99__V4\|8981 | 62 | 77 | 61 | 16 | | | | | 60 | 69 | 59 | 18 |
| 126 | 1007 | B1.0\|REF97__V4\|9526 | 137 | B1.0\|REF99__V4\|11 | 54 | 119 | 54 | 21 | | | | | | | | |
| 127 | 1007 | B1.0\|REF97__V4\|9526 | 884 | B1.0\|REF99__V4\|1164 | 54 | 54 | 41 | 10 | | | | | | | | |
| 128 | 1007 | B1.0\|REF97__V4\|9526 | 959 | B1.0\|REF99__V4\|126 | 54 | 71 | 44 | 13 | | | | | | | | |
| 129 | 1007 | B1.0\|REF97__V4\|9526 | 71 | B1.0\|REF99__V4\|1351 | 54 | 70 | 44 | 12 | | | | | | | | |
| 130 | 1007 | B1.0\|REF97__V4\|9526 | 1011 | B1.0\|REF99__V4\|2104 | 54 | 62 | 42 | 11 | | | | | | | | |
| 131 | 1007 | B1.0\|REF97__V4\|9526 | 789 | B1.0\|REF99__V4\|2172 | 54 | 97 | 48 | 17 | | | | | | | | |
| 132 | 1007 | B1.0\|REF97__V4\|9526 | 943 | B1.0\|REF99__V4\|26030 | 54 | 63 | 46 | 11 | | | | | | | | |
| 133 | 1007 | B1.0\|REF97__V4\|9526 | 974 | B1.0\|REF99__V4\|2831 | 54 | 79 | 52 | 14 | | | | | | | | |
| 134 | 1007 | B1.0\|REF97__V4\|9526 | 615 | B1.0\|REF99__V4\|3374 | 54 | 64 | 44 | 11 | | | | | | | | |
| 135 | 1007 | B1.0\|REF97__V4\|9526 | 916 | B1.0\|REF99__V4\|3675 | 54 | 77 | 52 | 14 | | | | | | | | |
| 136 | 1007 | B1.0\|REF97__V4\|9526 | 1012 | B1.0\|REF99__V4\|597 | 54 | 73 | 49 | 13 | | | | | | | | |
| 137 | 1007 | B1.0\|REF97__V4\|9526 | 837 | B1.0\|REF99__V4\|720 | 54 | 125 | 54 | 22 | | | | | | | | |
| 138 | 1007 | B1.0\|REF97__V4\|9526 | 1007 | B1.0\|REF99__V4\|9526 | 54 | 83 | 50 | 15 | | | | | | | | |
| 139 | 372 | B1.0\|REF99__V4\|10206 | 881 | B1.0\|REF99__V4\|434 | 115 | 103 | 74 | 39 | | | | | 114 | 101 | 74 | 51 |
| 140 | 1110 | B1.0\|REF99__V4\|108549 | 1081 | B1.0\|REF99__V4\|156009 | 55 | 67 | 43 | 12 | | | | | 55 | 67 | 43 | 16 |
| 141 | 1110 | B1.0\|REF99__V4\|108549 | 1097 | B1.0\|REF99__V4\|159716 | 55 | 44 | 39 | 8 | | | | | 55 | 44 | 39 | 11 |
| 142 | 1110 | B1.0\|REF99__V4\|108549 | 1080 | B1.0\|REF99__V4\|19 | 55 | 67 | 45 | 12 | | | | | 55 | 61 | 45 | 15 |
| 143 | 1110 | B1.0\|REF99__V4\|108549 | 1086 | B1.0\|REF99__V4\|25794 | 55 | 76 | 46 | 14 | | | | | 55 | 76 | 46 | 18 |
| 144 | 1110 | B1.0\|REF99__V4\|108549 | 1093 | B1.0\|REF99__V4\|29 | 55 | 69 | 46 | 12 | | | | | 55 | 64 | 46 | 16 |
| 145 | 137 | B1.0\|REF99__V4\|11 | 884 | B1.0\|REF99__V4\|1164 | 119 | 54 | 54 | 21 | | | | | | | | |
| 146 | 137 | B1.0\|REF99__V4\|11 | 959 | B1.0\|REF99__V4\|126 | 119 | 71 | 70 | 28 | | | | | | | | |
| 147 | 137 | B1.0\|REF99__V4\|11 | 71 | B1.0\|REF99__V4\|1351 | 119 | 70 | 67 | 27 | | | | | | | | |
| 148 | 137 | B1.0\|REF99__V4\|11 | 116 | B1.0\|REF99__V4\|1567 | 119 | 68 | 63 | 26 | | | | | | | | |
| 149 | 137 | B1.0\|REF99__V4\|11 | 1180 | B1.0\|REF99__V4\|166 | 119 | 101 | 71 | 39 | | | | | | | | |
| 150 | 137 | B1.0\|REF99__V4\|11 | 656 | B1.0\|REF99__V4\|191 | 119 | 81 | 67 | 32 | | | | | | | | |
| 151 | 137 | B1.0\|REF99__V4\|11 | 1011 | B1.0\|REF99__V4\|2104 | 119 | 62 | 61 | 24 | | | | | | | | |
| 152 | 137 | B1.0\|REF99__V4\|11 | 789 | B1.0\|REF99__V4\|2172 | 119 | 97 | 82 | 38 | | | | | | | | |
| 153 | 137 | B1.0\|REF99__V4\|11 | 810 | B1.0\|REF99__V4\|250 | 119 | 61 | 60 | 24 | | | | | | | | |
| 154 | 137 | B1.0\|REF99__V4\|11 | 943 | B1.0\|REF99__V4\|26030 | 119 | 63 | 62 | 25 | | | | | | | | |
| 155 | 137 | B1.0\|REF99__V4\|11 | 974 | B1.0\|REF99__V4\|2831 | 119 | 79 | 78 | 31 | | | | | | | | |
| 156 | 137 | B1.0\|REF99__V4\|11 | 615 | B1.0\|REF99__V4\|3374 | 119 | 64 | 63 | 25 | | | | | | | | |
| 157 | 137 | B1.0\|REF99__V4\|11 | 963 | B1.0\|REF99__V4\|33855 | 119 | 58 | 55 | 23 | | | | | | | | |
| 158 | 137 | B1.0\|REF99__V4\|11 | 916 | B1.0\|REF99__V4\|3675 | 119 | 77 | 76 | 30 | | | | | | | | |
| 159 | 137 | B1.0\|REF99__V4\|11 | 880 | B1.0\|REF99__V4\|472 | 119 | 66 | 63 | 26 | | | | | | | | |
| 160 | 137 | B1.0\|REF99__V4\|11 | 69 | B1.0\|REF99__V4\|506 | 119 | 58 | 57 | 23 | | | | | | | | |
| 161 | 137 | B1.0\|REF99__V4\|11 | 1012 | B1.0\|REF99__V4\|597 | 119 | 73 | 72 | 28 | | | | | | | | |
| 162 | 137 | B1.0\|REF99__V4\|11 | 837 | B1.0\|REF99__V4\|720 | 119 | 125 | 89 | 49 | | | | | | | | |
| 163 | 137 | B1.0\|REF99__V4\|11 | 713 | B1.0\|REF99__V4\|754 | 119 | 76 | 67 | 30 | | | | | | | | |
| 164 | 137 | B1.0\|REF99__V4\|11 | 915 | B1.0\|REF99__V4\|884 | 119 | 55 | 54 | 21 | | | | | | | | |
| 165 | 137 | B1.0\|REF99__V4\|11 | 1007 | B1.0\|REF99__V4\|9526 | 119 | 83 | 75 | 32 | | | | | | | | |
| 166 | 884 | B1.0\|REF99__V4\|1164 | 959 | B1.0\|REF99__V4\|126 | 54 | 71 | 48 | 13 | | | | | | | | |
| 167 | 884 | B1.0\|REF99__V4\|1164 | 71 | B1.0\|REF99__V4\|1351 | 54 | 70 | 47 | 12 | | | | | | | | |
| 168 | 884 | B1.0\|REF99__V4\|1164 | 1011 | B1.0\|REF99__V4\|2104 | 54 | 62 | 45 | 11 | | | | | | | | |
| 169 | 884 | B1.0\|REF99__V4\|1164 | 789 | B1.0\|REF99__V4\|2172 | 54 | 97 | 51 | 17 | | | | | | | | |
| 170 | 884 | B1.0\|REF99__V4\|1164 | 810 | B1.0\|REF99__V4\|250 | 54 | 61 | 42 | 11 | | | | | | | | |
| 171 | 884 | B1.0\|REF99__V4\|1164 | 943 | B1.0\|REF99__V4\|26030 | 54 | 63 | 45 | 11 | | | | | | | | |
| 172 | 884 | B1.0\|REF99__V4\|1164 | 974 | B1.0\|REF99__V4\|2831 | 54 | 79 | 54 | 14 | | | | | | | | |
| 173 | 884 | B1.0\|REF99__V4\|1164 | 615 | B1.0\|REF99__V4\|3374 | 54 | 64 | 45 | 11 | | | | | | | | |
| 174 | 884 | B1.0\|REF99__V4\|1164 | 916 | B1.0\|REF99__V4\|3675 | 54 | 77 | 53 | 14 | | | | | | | | |
| 175 | 884 | B1.0\|REF99__V4\|1164 | 1012 | B1.0\|REF99__V4\|597 | 54 | 73 | 51 | 13 | | | | | | | | |
| 176 | 884 | B1.0\|REF99__V4\|1164 | 837 | B1.0\|REF99__V4\|720 | 54 | 125 | 54 | 22 | | | | | | | | |
| 177 | 884 | B1.0\|REF99__V4\|1164 | 1007 | B1.0\|REF99__V4\|9526 | 54 | 83 | 50 | 15 | | | | | | | | |
| 178 | 121 | B1.0\|REF99__V4\|1211 | 1158 | B1.0\|REF99__V4\|1323 | 117 | 138 | 84 | 53 | | | | | 74 | 101 | 57 | 33 |
| 179 | 959 | B1.0\|REF99__V4\|126 | 71 | B1.0\|REF99__V4\|1351 | 71 | 70 | 61 | 16 | | | | | | | | |
| 180 | 959 | B1.0\|REF99__V4\|126 | 648 | B1.0\|REF99__V4\|14 | 71 | 171 | 71 | 40 | | | | | | | | |
| 181 | 959 | B1.0\|REF99__V4\|126 | 116 | B1.0\|REF99__V4\|1567 | 71 | 68 | 57 | 16 | | | | | | | | |
| 182 | 959 | B1.0\|REF99__V4\|126 | 1180 | B1.0\|REF99__V4\|166 | 71 | 101 | 54 | 23 | | | | | | | | |
| 183 | 959 | B1.0\|REF99__V4\|126 | 656 | B1.0\|REF99__V4\|191 | 71 | 81 | 52 | 19 | | | | | | | | |
| 184 | 959 | B1.0\|REF99__V4\|126 | 1011 | B1.0\|REF99__V4\|2104 | 71 | 62 | 57 | 14 | | | | | | | | |
| 185 | 959 | B1.0\|REF99__V4\|126 | 789 | B1.0\|REF99__V4\|2172 | 71 | 97 | 67 | 23 | | | | | | | | |
| 186 | 959 | B1.0\|REF99__V4\|126 | 810 | B1.0\|REF99__V4\|250 | 71 | 61 | 55 | 14 | | | | | | | | |
| 187 | 959 | B1.0\|REF99__V4\|126 | 131 | B1.0\|REF99__V4\|251 | 71 | 63 | 48 | 15 | | | | | | | | |
| 188 | 959 | B1.0\|REF99__V4\|126 | 943 | B1.0\|REF99__V4\|26030 | 71 | 63 | 57 | 15 | | | | | | | | |

TABLE 10-continued

| A PAIR | B Endophyte 1 (SEQ ID NO:) | C Endophyte 1 (OTU) | D Endophyte 2 (SEQ ID NO:) | E Endophyte 2 (OTU) | F Bacteria - all | | | | G Bacteria - roots | | | | H Bacteria - seeds | | | |
|---|---|---|---|---|---|---|---|---|---|---|---|---|---|---|---|---|
| | | | | | N1 | N2 | OC | EC | N1 | N2 | OC | EC | N1 | N2 | OC | EC |
| 189 | 959 | B1.0|REF99_V4|126 | 974 | B1.0|REF99_V4|2831 | 71 | 79 | 71 | 18 | | | | | | | | |
| 190 | 959 | B1.0|REF99_V4|126 | 615 | B1.0|REF99_V4|3374 | 71 | 64 | 57 | 15 | | | | | | | | |
| 191 | 959 | B1.0|REF99_V4|126 | 963 | B1.0|REF99_V4|33855 | 71 | 58 | 47 | 14 | | | | | | | | |
| 192 | 959 | B1.0|REF99_V4|126 | 961 | B1.0|REF99_V4|3580 | 71 | 42 | 42 | 10 | | | | | | | | |
| 193 | 959 | B1.0|REF99_V4|126 | 916 | B1.0|REF99_V4|3675 | 71 | 77 | 69 | 18 | | | | | | | | |
| 194 | 959 | B1.0|REF99_V4|126 | 945 | B1.0|REF99_V4|442 | 71 | 46 | 42 | 11 | | | | | | | | |
| 195 | 959 | B1.0|REF99_V4|126 | 880 | B1.0|REF99_V4|472 | 71 | 66 | 51 | 15 | | | | | | | | |
| 196 | 959 | B1.0|REF99_V4|126 | 69 | B1.0|REF99_V4|506 | 71 | 58 | 50 | 14 | | | | | | | | |
| 197 | 959 | B1.0|REF99_V4|126 | 1012 | B1.0|REF99_V4|597 | 71 | 73 | 66 | 17 | | | | | | | | |
| 198 | 959 | B1.0|REF99_V4|126 | 837 | B1.0|REF99_V4|720 | 71 | 125 | 71 | 29 | | | | | | | | |
| 199 | 959 | B1.0|REF99_V4|126 | 713 | B1.0|REF99_V4|754 | 71 | 76 | 60 | 18 | | | | | | | | |
| 200 | 959 | B1.0|REF99_V4|126 | 915 | B1.0|REF99_V4|884 | 71 | 55 | 51 | 13 | | | | | | | | |
| 201 | 959 | B1.0|REF99_V4|126 | 1007 | B1.0|REF99_V4|9526 | 71 | 83 | 64 | 19 | | | | | | | | |
| 202 | 886 | B1.0|REF99_V4|1287 | 974 | B1.0|REF99_V4|2831 | 44 | 79 | 43 | 11 | | | | | | | | |
| 203 | 886 | B1.0|REF99_V4|1287 | 916 | B1.0|REF99_V4|3675 | 44 | 77 | 42 | 11 | | | | | | | | |
| 204 | 939 | B1.0|REF99_V4|1317 | 1012 | B1.0|REF99_V4|597 | 56 | 73 | 44 | 13 | | | | | | | | |
| 205 | 71 | B1.0|REF99_V4|1351 | 116 | B1.0|REF99_V4|1567 | 70 | 68 | 53 | 16 | | | | | | | | |
| 206 | 71 | B1.0|REF99_V4|1351 | 1011 | B1.0|REF99_V4|2104 | 70 | 62 | 54 | 14 | | | | | | | | |
| 207 | 71 | B1.0|REF99_V4|1351 | 789 | B1.0|REF99_V4|2172 | 70 | 97 | 64 | 22 | | | | | | | | |
| 208 | 71 | B1.0|REF99_V4|1351 | 810 | B1.0|REF99_V4|250 | 70 | 61 | 51 | 14 | | | | | | | | |
| 209 | 71 | B1.0|REF99_V4|1351 | 131 | B1.0|REF99_V4|251 | 70 | 63 | 48 | 14 | | | | | | | | |
| 210 | 71 | B1.0|REF99_V4|1351 | 943 | B1.0|REF99_V4|26030 | 70 | 63 | 55 | 14 | | | | | | | | |
| 211 | 71 | B1.0|REF99_V4|1351 | 974 | B1.0|REF99_V4|2831 | 70 | 79 | 68 | 18 | | | | | | | | |
| 212 | 71 | B1.0|REF99_V4|1351 | 615 | B1.0|REF99_V4|3374 | 70 | 64 | 56 | 15 | | | | | | | | |
| 213 | 71 | B1.0|REF99_V4|1351 | 963 | B1.0|REF99_V4|33855 | 70 | 58 | 47 | 13 | | | | | | | | |
| 214 | 71 | B1.0|REF99_V4|1351 | 916 | B1.0|REF99_V4|3675 | 70 | 77 | 66 | 18 | | | | | | | | |
| 215 | 71 | B1.0|REF99_V4|1351 | 880 | B1.0|REF99_V4|472 | 70 | 66 | 51 | 15 | | | | | | | | |
| 216 | 71 | B1.0|REF99_V4|1351 | 69 | B1.0|REF99_V4|506 | 70 | 58 | 49 | 13 | | | | | | | | |
| 217 | 71 | B1.0|REF99_V4|1351 | 1012 | B1.0|REF99_V4|597 | 70 | 73 | 62 | 17 | | | | | | | | |
| 218 | 71 | B1.0|REF99_V4|1351 | 837 | B1.0|REF99_V4|720 | 70 | 125 | 68 | 29 | | | | | | | | |
| 219 | 71 | B1.0|REF99_V4|1351 | 713 | B1.0|REF99_V4|754 | 70 | 76 | 57 | 17 | | | | | | | | |
| 220 | 71 | B1.0|REF99_V4|1351 | 915 | B1.0|REF99_V4|884 | 70 | 55 | 50 | 13 | | | | | | | | |
| 221 | 71 | B1.0|REF99_V4|1351 | 1007 | B1.0|REF99_V4|9526 | 70 | 83 | 62 | 19 | | | | | | | | |
| 222 | 648 | B1.0|REF99_V4|14 | 1180 | B1.0|REF99_V4|166 | 171 | 101 | 87 | 56 | | | | | | | | |
| 223 | 648 | B1.0|REF99_V4|14 | 974 | B1.0|REF99_V4|2831 | 171 | 79 | 79 | 44 | | | | | | | | |
| 224 | 648 | B1.0|REF99_V4|14 | 916 | B1.0|REF99_V4|3675 | 171 | 77 | 77 | 43 | | | | | | | | |
| 225 | 648 | B1.0|REF99_V4|14 | 1012 | B1.0|REF99_V4|597 | 171 | 73 | 73 | 41 | | | | | | | | |
| 226 | 648 | B1.0|REF99_V4|14 | 713 | B1.0|REF99_V4|754 | 171 | 76 | 74 | 43 | | | | | | | | |
| 227 | 648 | B1.0|REF99_V4|14 | 1007 | B1.0|REF99_V4|9526 | 171 | 83 | 78 | 46 | | | | | | | | |
| 228 | 1112 | B1.0|REF99_V4|14460 | 1088 | B1.0|REF99_V4|1703 | 129 | 120 | 87 | 51 | | | | | | | | |
| 229 | 1112 | B1.0|REF99_V4|14460 | 1109 | B1.0|REF99_V4|25629 | 129 | 122 | 110 | 51 | | | | | 129 | 122 | 110 | 69 |
| 230 | 1112 | B1.0|REF99_V4|14460 | 1094 | B1.0|REF99_V4|387 | 129 | 91 | 69 | 38 | | | | | 129 | 73 | 69 | 42 |
| 231 | 1112 | B1.0|REF99_V4|14460 | 1095 | B1.0|REF99_V4|54497 | 129 | 93 | 75 | 39 | | | | | | | | |
| 232 | 1091 | B1.0|REF99_V4|15 | 1080 | B1.0|REF99_V4|19 | 80 | 67 | 51 | 18 | | | | | 72 | 61 | 48 | 19 |
| 233 | 1091 | B1.0|REF99_V4|15 | 1077 | B1.0|REF99_V4|209 | 80 | 93 | 59 | 24 | | | | | 72 | 91 | 58 | 29 |
| 234 | 1091 | B1.0|REF99_V4|15 | 1086 | B1.0|REF99_V4|25794 | 80 | 76 | 51 | 20 | | | | | 72 | 76 | 51 | 24 |
| 235 | 1091 | B1.0|REF99_V4|15 | 1093 | B1.0|REF99_V4|29 | 80 | 69 | 50 | 18 | | | | | 72 | 64 | 48 | 20 |
| 236 | 1191 | B1.0|REF99_V4|150716 | 972 | B1.0|REF99_V4|218 | 87 | 99 | 68 | 28 | | | | | 86 | 99 | 68 | 38 |
| 237 | 1191 | B1.0|REF99_V4|150716 | 1163 | B1.0|REF99_V4|6806 | 87 | 87 | 57 | 25 | | | | | 86 | 87 | 57 | 33 |
| 238 | 1191 | B1.0|REF99_V4|150716 | 957 | B1.0|REF99_V4|921 | 87 | 95 | 62 | 27 | | | | | 86 | 80 | 61 | 30 |
| 239 | 1081 | B1.0|REF99_V4|156009 | 1077 | B1.0|REF99_V4|209 | 67 | 93 | 53 | 20 | | | | | 67 | 91 | 53 | 27 |
| 240 | 1081 | B1.0|REF99_V4|156009 | 1086 | B1.0|REF99_V4|25794 | 67 | 76 | 51 | 17 | | | | | 67 | 76 | 51 | 22 |
| 241 | 1081 | B1.0|REF99_V4|156009 | 1093 | B1.0|REF99_V4|29 | 67 | 69 | 47 | 15 | | | | | 67 | 64 | 47 | 19 |
| 242 | 739 | B1.0|REF99_V4|1562 | 974 | B1.0|REF99_V4|2831 | 51 | 79 | 45 | 13 | | | | | | | | |
| 243 | 739 | B1.0|REF99_V4|1562 | 916 | B1.0|REF99_V4|3675 | 51 | 77 | 45 | 13 | | | | | | | | |
| 244 | 739 | B1.0|REF99_V4|1562 | 1012 | B1.0|REF99_V4|597 | 51 | 73 | 44 | 12 | | | | | | | | |
| 245 | 116 | B1.0|REF99_V4|1567 | 1011 | B1.0|REF99_V4|2104 | 68 | 62 | 47 | 14 | | | | | | | | |
| 246 | 116 | B1.0|REF99_V4|1567 | 789 | B1.0|REF99_V4|2172 | 68 | 97 | 61 | 22 | | | | | | | | |
| 247 | 116 | B1.0|REF99_V4|1567 | 810 | B1.0|REF99_V4|250 | 68 | 61 | 48 | 14 | | | | | | | | |
| 248 | 116 | B1.0|REF99_V4|1567 | 943 | B1.0|REF99_V4|26030 | 68 | 63 | 51 | 14 | | | | | | | | |
| 249 | 116 | B1.0|REF99_V4|1567 | 974 | B1.0|REF99_V4|2831 | 68 | 79 | 61 | 18 | | | | | | | | |
| 250 | 116 | B1.0|REF99_V4|1567 | 615 | B1.0|REF99_V4|3374 | 68 | 64 | 47 | 14 | | | | | | | | |
| 251 | 116 | B1.0|REF99_V4|1567 | 916 | B1.0|REF99_V4|3675 | 68 | 77 | 60 | 17 | | | | | | | | |
| 252 | 116 | B1.0|REF99_V4|1567 | 880 | B1.0|REF99_V4|472 | 68 | 66 | 47 | 15 | | | | | | | | |
| 253 | 116 | B1.0|REF99_V4|1567 | 69 | B1.0|REF99_V4|506 | 68 | 58 | 44 | 13 | | | | | | | | |
| 254 | 116 | B1.0|REF99_V4|1567 | 1012 | B1.0|REF99_V4|597 | 68 | 73 | 55 | 16 | | | | | | | | |
| 255 | 116 | B1.0|REF99_V4|1567 | 837 | B1.0|REF99_V4|720 | 68 | 125 | 63 | 28 | | | | | | | | |
| 256 | 116 | B1.0|REF99_V4|1567 | 713 | B1.0|REF99_V4|754 | 68 | 76 | 54 | 17 | | | | | | | | |
| 257 | 116 | B1.0|REF99_V4|1567 | 915 | B1.0|REF99_V4|884 | 68 | 55 | 43 | 12 | | | | | | | | |
| 258 | 116 | B1.0|REF99_V4|1567 | 1007 | B1.0|REF99_V4|9526 | 68 | 83 | 58 | 18 | | | | | | | | |
| 259 | 1097 | B1.0|REF99_V4|159716 | 1086 | B1.0|REF99_V4|25794 | 44 | 76 | 43 | 11 | | | | | 44 | 76 | 43 | 15 |
| 260 | 1171 | B1.0|REF99_V4|1639 | 943 | B1.0|REF99_V4|26030 | 43 | 63 | 40 | 9 | | | | | | | | |
| 261 | 1171 | B1.0|REF99_V4|1639 | 974 | B1.0|REF99_V4|2831 | 43 | 79 | 43 | 11 | | | | | | | | |

TABLE 10-continued

| A PAIR | B Endophyte 1 (SEQ ID NO:) | C Endophyte 1 (OTU) | D Endophyte 2 (SEQ ID NO:) | E Endophyte 2 (OTU) | F Bacteria - all | | | | G Bacteria - roots | | | | H Bacteria - seeds | | | |
|---|---|---|---|---|---|---|---|---|---|---|---|---|---|---|---|---|
| | | | | | N1 | N2 | OC | EC | N1 | N2 | OC | EC | N1 | N2 | OC | EC |
| 262 | 1171 | B1.0|REF99__V4|1639 | 916 | B1.0|REF99__V4|3675 | 43 | 77 | 43 | 11 | | | | | | | | |
| 263 | 1180 | B1.0|REF99__V4|166 | 974 | B1.0|REF99__V4|2831 | 101 | 79 | 59 | 26 | | | | | | | | |
| 264 | 1180 | B1.0|REF99__V4|166 | 916 | B1.0|REF99__V4|3675 | 101 | 77 | 58 | 25 | | | | | | | | |
| 265 | 1180 | B1.0|REF99__V4|166 | 1012 | B1.0|REF99__V4|597 | 101 | 73 | 56 | 24 | | | | | | | | |
| 266 | 1088 | B1.0|REF99__V4|1703 | 1077 | B1.0|REF99__V4|209 | 120 | 93 | 77 | 37 | | | | | 120 | 91 | 77 | 48 |
| 267 | 1088 | B1.0|REF99__V4|1703 | 1109 | B1.0|REF99__V4|25629 | 120 | 122 | 93 | 48 | | | | | 120 | 122 | 93 | 65 |
| 268 | 1088 | B1.0|REF99__V4|1703 | 1095 | B1.0|REF99__V4|54497 | 120 | 93 | 73 | 37 | | | | | 120 | 93 | 73 | 49 |
| 269 | 889 | B1.0|REF99__V4|185 | 789 | B1.0|REF99__V4|2172 | 63 | 97 | 51 | 20 | | | | | | | | |
| 270 | 889 | B1.0|REF99__V4|185 | 974 | B1.0|REF99__V4|2831 | 63 | 79 | 50 | 16 | | | | | | | | |
| 271 | 889 | B1.0|REF99__V4|185 | 916 | B1.0|REF99__V4|3675 | 63 | 77 | 49 | 16 | | | | | | | | |
| 272 | 889 | B1.0|REF99__V4|185 | 1012 | B1.0|REF99__V4|597 | 63 | 73 | 46 | 15 | | | | | | | | |
| 273 | 1080 | B1.0|REF99__V4|19 | 1086 | B1.0|REF99__V4|25794 | 67 | 76 | 51 | 17 | | | | | 61 | 76 | 51 | 20 |
| 274 | 1080 | B1.0|REF99__V4|19 | 1093 | B1.0|REF99__V4|29 | 67 | 69 | 48 | 15 | | | | | 61 | 64 | 45 | 17 |
| 275 | 656 | B1.0|REF99__V4|191 | 789 | B1.0|REF99__V4|2172 | 81 | 97 | 60 | 26 | | | | | | | | |
| 276 | 656 | B1.0|REF99__V4|191 | 974 | B1.0|REF99__V4|2831 | 81 | 79 | 57 | 21 | | | | | | | | |
| 277 | 656 | B1.0|REF99__V4|191 | 916 | B1.0|REF99__V4|3675 | 81 | 77 | 55 | 20 | | | | | | | | |
| 278 | 656 | B1.0|REF99__V4|191 | 1012 | B1.0|REF99__V4|597 | 81 | 73 | 53 | 19 | | | | | | | | |
| 279 | 656 | B1.0|REF99__V4|191 | 837 | B1.0|REF99__V4|720 | 81 | 125 | 64 | 33 | | | | | | | | |
| 280 | 656 | B1.0|REF99__V4|191 | 713 | B1.0|REF99__V4|754 | 81 | 76 | 57 | 20 | | | | | | | | |
| 281 | 656 | B1.0|REF99__V4|191 | 915 | B1.0|REF99__V4|884 | 81 | 55 | 46 | 15 | | | | | | | | |
| 282 | 656 | B1.0|REF99__V4|191 | 1007 | B1.0|REF99__V4|9526 | 81 | 83 | 54 | 22 | | | | | | | | |
| 283 | 1195 | B1.0|REF99__V4|1916 | 881 | B1.0|REF99__V4|434 | 68 | 103 | 57 | 23 | | | | | 68 | 101 | 57 | 30 |
| 284 | 1077 | B1.0|REF99__V4|209 | 1109 | B1.0|REF99__V4|25629 | 93 | 122 | 73 | 37 | | | | | 91 | 122 | 73 | 49 |
| 285 | 1077 | B1.0|REF99__V4|209 | 1086 | B1.0|REF99__V4|25794 | 93 | 76 | 54 | 23 | | | | | 91 | 76 | 54 | 31 |
| 286 | 1011 | B1.0|REF99__V4|2104 | 789 | B1.0|REF99__V4|2172 | 62 | 97 | 60 | 20 | | | | | | | | |
| 287 | 1011 | B1.0|REF99__V4|2104 | 810 | B1.0|REF99__V4|250 | 62 | 61 | 45 | 12 | | | | | | | | |
| 288 | 1011 | B1.0|REF99__V4|2104 | 131 | B1.0|REF99__V4|251 | 62 | 63 | 44 | 13 | | | | | | | | |
| 289 | 1011 | B1.0|REF99__V4|2104 | 943 | B1.0|REF99__V4|26030 | 62 | 63 | 54 | 13 | | | | | | | | |
| 290 | 1011 | B1.0|REF99__V4|2104 | 974 | B1.0|REF99__V4|2831 | 62 | 79 | 62 | 16 | | | | | | | | |
| 291 | 1011 | B1.0|REF99__V4|2104 | 615 | B1.0|REF99__V4|3374 | 62 | 64 | 54 | 13 | | | | | | | | |
| 292 | 1011 | B1.0|REF99__V4|2104 | 963 | B1.0|REF99__V4|33855 | 62 | 58 | 47 | 12 | | | | | | | | |
| 293 | 1011 | B1.0|REF99__V4|2104 | 916 | B1.0|REF99__V4|3675 | 62 | 77 | 62 | 16 | | | | | | | | |
| 294 | 1011 | B1.0|REF99__V4|2104 | 880 | B1.0|REF99__V4|472 | 62 | 66 | 46 | 13 | | | | | | | | |
| 295 | 1011 | B1.0|REF99__V4|2104 | 69 | B1.0|REF99__V4|506 | 62 | 58 | 45 | 12 | | | | | | | | |
| 296 | 1011 | B1.0|REF99__V4|2104 | 1012 | B1.0|REF99__V4|597 | 62 | 73 | 56 | 15 | | | | | | | | |
| 297 | 1011 | B1.0|REF99__V4|2104 | 837 | B1.0|REF99__V4|720 | 62 | 125 | 62 | 25 | | | | | | | | |
| 298 | 1011 | B1.0|REF99__V4|2104 | 713 | B1.0|REF99__V4|754 | 62 | 76 | 53 | 15 | | | | | | | | |
| 299 | 1011 | B1.0|REF99__V4|2104 | 915 | B1.0|REF99__V4|884 | 62 | 55 | 43 | 11 | | | | | | | | |
| 300 | 1011 | B1.0|REF99__V4|2104 | 1007 | B1.0|REF99__V4|9526 | 62 | 83 | 57 | 17 | | | | | | | | |
| 301 | 789 | B1.0|REF99__V4|2172 | 810 | B1.0|REF99__V4|250 | 97 | 61 | 57 | 19 | | | | | | | | |
| 302 | 789 | B1.0|REF99__V4|2172 | 131 | B1.0|REF99__V4|251 | 97 | 63 | 51 | 20 | | | | | | | | |
| 303 | 789 | B1.0|REF99__V4|2172 | 943 | B1.0|REF99__V4|26030 | 97 | 63 | 61 | 20 | | | | | | | | |
| 304 | 789 | B1.0|REF99__V4|2172 | 974 | B1.0|REF99__V4|2831 | 97 | 79 | 74 | 25 | | | | | | | | |
| 305 | 789 | B1.0|REF99__V4|2172 | 615 | B1.0|REF99__V4|3374 | 97 | 64 | 60 | 20 | | | | | | | | |
| 306 | 789 | B1.0|REF99__V4|2172 | 963 | B1.0|REF99__V4|33855 | 97 | 58 | 52 | 18 | | | | | | | | |
| 307 | 789 | B1.0|REF99__V4|2172 | 916 | B1.0|REF99__V4|3675 | 97 | 77 | 72 | 24 | | | | | | | | |
| 308 | 789 | B1.0|REF99__V4|2172 | 880 | B1.0|REF99__V4|472 | 97 | 66 | 55 | 21 | | | | | | | | |
| 309 | 789 | B1.0|REF99__V4|2172 | 69 | B1.0|REF99__V4|506 | 97 | 58 | 54 | 18 | | | | | | | | |
| 310 | 789 | B1.0|REF99__V4|2172 | 1012 | B1.0|REF99__V4|597 | 97 | 73 | 68 | 23 | | | | | | | | |
| 311 | 789 | B1.0|REF99__V4|2172 | 837 | B1.0|REF99__V4|720 | 97 | 125 | 81 | 40 | | | | | | | | |
| 312 | 789 | B1.0|REF99__V4|2172 | 713 | B1.0|REF99__V4|754 | 97 | 76 | 64 | 24 | | | | | | | | |
| 313 | 789 | B1.0|REF99__V4|2172 | 915 | B1.0|REF99__V4|884 | 97 | 55 | 52 | 17 | | | | | | | | |
| 314 | 789 | B1.0|REF99__V4|2172 | 1007 | B1.0|REF99__V4|9526 | 97 | 83 | 70 | 26 | | | | | | | | |
| 315 | 972 | B1.0|REF99__V4|218 | 957 | B1.0|REF99__V4|921 | 99 | 95 | 63 | 31 | | | | | 99 | 80 | 63 | 35 |
| 316 | 681 | B1.0|REF99__V4|234 | 837 | B1.0|REF99__V4|720 | 94 | 125 | 69 | 38 | | | | | | | | |
| 317 | 683 | B1.0|REF99__V4|2385 | 974 | B1.0|REF99__V4|2831 | 42 | 79 | 42 | 11 | | | | | | | | |
| 318 | 683 | B1.0|REF99__V4|2385 | 1012 | B1.0|REF99__V4|597 | 42 | 73 | 42 | 10 | | | | | | | | |
| 319 | 810 | B1.0|REF99__V4|250 | 943 | B1.0|REF99__V4|26030 | 61 | 63 | 47 | 13 | | | | | | | | |
| 320 | 810 | B1.0|REF99__V4|250 | 974 | B1.0|REF99__V4|2831 | 61 | 79 | 61 | 16 | | | | | | | | |
| 321 | 810 | B1.0|REF99__V4|250 | 615 | B1.0|REF99__V4|3374 | 61 | 64 | 49 | 13 | | | | | | | | |
| 322 | 810 | B1.0|REF99__V4|250 | 916 | B1.0|REF99__V4|3675 | 61 | 77 | 59 | 15 | | | | | | | | |
| 323 | 810 | B1.0|REF99__V4|250 | 880 | B1.0|REF99__V4|472 | 61 | 66 | 45 | 13 | | | | | | | | |
| 324 | 810 | B1.0|REF99__V4|250 | 1012 | B1.0|REF99__V4|597 | 61 | 73 | 59 | 15 | | | | | | | | |
| 325 | 810 | B1.0|REF99__V4|250 | 837 | B1.0|REF99__V4|720 | 61 | 125 | 61 | 25 | | | | | | | | |
| 326 | 810 | B1.0|REF99__V4|250 | 713 | B1.0|REF99__V4|754 | 61 | 76 | 49 | 15 | | | | | | | | |
| 327 | 810 | B1.0|REF99__V4|250 | 915 | B1.0|REF99__V4|884 | 61 | 55 | 42 | 11 | | | | | | | | |
| 328 | 810 | B1.0|REF99__V4|250 | 1007 | B1.0|REF99__V4|9526 | 61 | 83 | 56 | 17 | | | | | | | | |
| 329 | 131 | B1.0|REF99__V4|251 | 974 | B1.0|REF99__V4|2831 | 63 | 79 | 53 | 16 | | | | | | | | |
| 330 | 131 | B1.0|REF99__V4|251 | 615 | B1.0|REF99__V4|3374 | 63 | 64 | 44 | 13 | | | | | | | | |
| 331 | 131 | B1.0|REF99__V4|251 | 916 | B1.0|REF99__V4|3675 | 63 | 77 | 51 | 16 | | | | | | | | |
| 332 | 131 | B1.0|REF99__V4|251 | 1012 | B1.0|REF99__V4|597 | 63 | 73 | 48 | 15 | | | | | | | | |
| 333 | 131 | B1.0|REF99__V4|251 | 837 | B1.0|REF99__V4|720 | 63 | 125 | 57 | 26 | | | | | | | | |
| 334 | 131 | B1.0|REF99__V4|251 | 713 | B1.0|REF99__V4|754 | 63 | 76 | 49 | 16 | | | | | | | | |

TABLE 10-continued

| A PAIR | B Endophyte 1 (SEQ ID NO:) | C Endophyte 1 (OTU) | D Endophyte 2 (SEQ ID NO:) | E Endophyte 2 (OTU) | F Bacteria - all | | | | G Bacteria - roots | | | | H Bacteria - seeds | | | |
|---|---|---|---|---|---|---|---|---|---|---|---|---|---|---|---|---|
| | | | | | N1 | N2 | OC | EC | N1 | N2 | OC | EC | N1 | N2 | OC | EC |
| 335 | 131 | B1.0\|REF99_V4\|251 | 1007 | B1.0\|REF99_V4\|9526 | 63 | 83 | 51 | 17 | | | | | | | | |
| 336 | 1109 | B1.0\|REF99_V4\|25629 | 1095 | B1.0\|REF99_V4\|54497 | 122 | 93 | 74 | 37 | | | | | 122 | 93 | 74 | 50 |
| 337 | 1086 | B1.0\|REF99_V4\|25794 | 1093 | B1.0\|REF99_V4\|29 | 76 | 69 | 48 | 17 | | | | | 76 | 64 | 48 | 21 |
| 338 | 943 | B1.0\|REF99_V4\|26030 | 974 | B1.0\|REF99_V4\|2831 | 63 | 79 | 63 | 16 | | | | | | | | |
| 339 | 943 | B1.0\|REF99_V4\|26030 | 615 | B1.0\|REF99_V4\|3374 | 63 | 64 | 53 | 13 | | | | | | | | |
| 340 | 943 | B1.0\|REF99_V4\|26030 | 963 | B1.0\|REF99_V4\|33855 | 63 | 58 | 44 | 12 | | | | | | | | |
| 341 | 943 | B1.0\|REF99_V4\|26030 | 916 | B1.0\|REF99_V4\|3675 | 63 | 77 | 63 | 16 | | | | | | | | |
| 342 | 943 | B1.0\|REF99_V4\|26030 | 880 | B1.0\|REF99_V4\|472 | 63 | 66 | 46 | 14 | | | | | | | | |
| 343 | 943 | B1.0\|REF99_V4\|26030 | 69 | B1.0\|REF99_V4\|506 | 63 | 58 | 45 | 12 | | | | | | | | |
| 344 | 943 | B1.0\|REF99_V4\|26030 | 1012 | B1.0\|REF99_V4\|597 | 63 | 73 | 57 | 15 | | | | | | | | |
| 345 | 943 | B1.0\|REF99_V4\|26030 | 837 | B1.0\|REF99_V4\|720 | 63 | 125 | 63 | 26 | | | | | | | | |
| 346 | 943 | B1.0\|REF99_V4\|26030 | 713 | B1.0\|REF99_V4\|754 | 63 | 76 | 51 | 16 | | | | | | | | |
| 347 | 943 | B1.0\|REF99_V4\|26030 | 915 | B1.0\|REF99_V4\|884 | 63 | 55 | 42 | 11 | | | | | | | | |
| 348 | 943 | B1.0\|REF99_V4\|26030 | 1007 | B1.0\|REF99_V4\|9526 | 63 | 83 | 58 | 17 | | | | | | | | |
| 349 | 974 | B1.0\|REF99_V4\|2831 | 615 | B1.0\|REF99_V4\|3374 | 79 | 64 | 64 | 17 | | | | | | | | |
| 350 | 974 | B1.0\|REF99_V4\|2831 | 963 | B1.0\|REF99_V4\|33855 | 79 | 58 | 54 | 15 | | | | | | | | |
| 351 | 974 | B1.0\|REF99_V4\|2831 | 961 | B1.0\|REF99_V4\|3580 | 79 | 42 | 42 | 11 | | | | | | | | |
| 352 | 974 | B1.0\|REF99_V4\|2831 | 916 | B1.0\|REF99_V4\|3675 | 79 | 77 | 77 | 20 | | | | | | | | |
| 353 | 974 | B1.0\|REF99_V4\|2831 | 945 | B1.0\|REF99_V4\|442 | 79 | 46 | 46 | 12 | | | | | | | | |
| 354 | 974 | B1.0\|REF99_V4\|2831 | 880 | B1.0\|REF99_V4\|472 | 79 | 66 | 57 | 17 | | | | | | | | |
| 355 | 974 | B1.0\|REF99_V4\|2831 | 69 | B1.0\|REF99_V4\|506 | 79 | 58 | 56 | 15 | | | | | | | | |
| 356 | 974 | B1.0\|REF99_V4\|2831 | 60 | B1.0\|REF99_V4\|514 | 79 | 42 | 42 | 11 | | | | | | | | |
| 357 | 974 | B1.0\|REF99_V4\|2831 | 1012 | B1.0\|REF99_V4\|597 | 79 | 73 | 73 | 19 | | | | | | | | |
| 358 | 974 | B1.0\|REF99_V4\|2831 | 319 | B1.0\|REF99_V4\|70731 | 79 | 45 | 45 | 12 | | | | | | | | |
| 359 | 974 | B1.0\|REF99_V4\|2831 | 837 | B1.0\|REF99_V4\|720 | 79 | 125 | 79 | 32 | | | | | | | | |
| 360 | 974 | B1.0\|REF99_V4\|2831 | 713 | B1.0\|REF99_V4\|754 | 79 | 76 | 65 | 20 | | | | | | | | |
| 361 | 974 | B1.0\|REF99_V4\|2831 | 915 | B1.0\|REF99_V4\|884 | 79 | 55 | 55 | 14 | | | | | | | | |
| 362 | 974 | B1.0\|REF99_V4\|2831 | 1007 | B1.0\|REF99_V4\|9526 | 79 | 83 | 72 | 21 | | | | | | | | |
| 363 | 1175 | B1.0\|REF99_V4\|284 | 826 | B1.0\|REF99_V4\|467 | 88 | 70 | 52 | 20 | | | | | 78 | 70 | 52 | 24 |
| 364 | 1175 | B1.0\|REF99_V4\|284 | 1199 | B1.0\|REF99_V4\|589 | 88 | 56 | 50 | 16 | | | | | 78 | 54 | 48 | 19 |
| 365 | 615 | B1.0\|REF99_V4\|3374 | 963 | B1.0\|REF99_V4\|33855 | 64 | 58 | 47 | 12 | | | | | | | | |
| 366 | 615 | B1.0\|REF99_V4\|3374 | 916 | B1.0\|REF99_V4\|3675 | 64 | 77 | 63 | 16 | | | | | | | | |
| 367 | 615 | B1.0\|REF99_V4\|3374 | 880 | B1.0\|REF99_V4\|472 | 64 | 66 | 48 | 14 | | | | | | | | |
| 368 | 615 | B1.0\|REF99_V4\|3374 | 69 | B1.0\|REF99_V4\|506 | 64 | 58 | 46 | 12 | | | | | | | | |
| 369 | 615 | B1.0\|REF99_V4\|3374 | 1012 | B1.0\|REF99_V4\|597 | 64 | 73 | 60 | 15 | | | | | | | | |
| 370 | 615 | B1.0\|REF99_V4\|3374 | 837 | B1.0\|REF99_V4\|720 | 64 | 125 | 64 | 26 | | | | | | | | |
| 371 | 615 | B1.0\|REF99_V4\|3374 | 713 | B1.0\|REF99_V4\|754 | 64 | 76 | 54 | 16 | | | | | | | | |
| 372 | 615 | B1.0\|REF99_V4\|3374 | 915 | B1.0\|REF99_V4\|884 | 64 | 55 | 44 | 12 | | | | | | | | |
| 373 | 615 | B1.0\|REF99_V4\|3374 | 1007 | B1.0\|REF99_V4\|9526 | 64 | 83 | 58 | 17 | | | | | | | | |
| 374 | 963 | B1.0\|REF99_V4\|33855 | 916 | B1.0\|REF99_V4\|3675 | 58 | 77 | 54 | 15 | | | | | | | | |
| 375 | 963 | B1.0\|REF99_V4\|33855 | 1012 | B1.0\|REF99_V4\|597 | 58 | 73 | 50 | 14 | | | | | | | | |
| 376 | 963 | B1.0\|REF99_V4\|33855 | 713 | B1.0\|REF99_V4\|754 | 58 | 76 | 46 | 14 | | | | | | | | |
| 377 | 963 | B1.0\|REF99_V4\|33855 | 1007 | B1.0\|REF99_V4\|9526 | 58 | 83 | 52 | 16 | | | | | | | | |
| 378 | 916 | B1.0\|REF99_V4\|3675 | 945 | B1.0\|REF99_V4\|442 | 77 | 46 | 45 | 12 | | | | | | | | |
| 379 | 916 | B1.0\|REF99_V4\|3675 | 880 | B1.0\|REF99_V4\|472 | 77 | 66 | 55 | 17 | | | | | | | | |
| 380 | 916 | B1.0\|REF99_V4\|3675 | 69 | B1.0\|REF99_V4\|506 | 77 | 58 | 55 | 15 | | | | | | | | |
| 381 | 916 | B1.0\|REF99_V4\|3675 | 1012 | B1.0\|REF99_V4\|597 | 77 | 73 | 71 | 18 | | | | | | | | |
| 382 | 916 | B1.0\|REF99_V4\|3675 | 319 | B1.0\|REF99_V4\|70731 | 77 | 45 | 44 | 11 | | | | | | | | |
| 383 | 916 | B1.0\|REF99_V4\|3675 | 837 | B1.0\|REF99_V4\|720 | 77 | 125 | 77 | 32 | | | | | | | | |
| 384 | 916 | B1.0\|REF99_V4\|3675 | 713 | B1.0\|REF99_V4\|754 | 77 | 76 | 63 | 19 | | | | | | | | |
| 385 | 916 | B1.0\|REF99_V4\|3675 | 915 | B1.0\|REF99_V4\|884 | 77 | 55 | 53 | 14 | | | | | | | | |
| 386 | 916 | B1.0\|REF99_V4\|3675 | 1007 | B1.0\|REF99_V4\|9526 | 77 | 83 | 71 | 21 | | | | | | | | |
| 387 | 1094 | B1.0\|REF99_V4\|387 | 1090 | B1.0\|REF99_V4\|79117 | 91 | 99 | 69 | 29 | | | | | 73 | 74 | 54 | 24 |
| 388 | 945 | B1.0\|REF99_V4\|442 | 1012 | B1.0\|REF99_V4\|597 | 46 | 73 | 44 | 11 | | | | | | | | |
| 389 | 880 | B1.0\|REF99_V4\|472 | 1012 | B1.0\|REF99_V4\|597 | 66 | 73 | 52 | 16 | | | | | | | | |
| 390 | 880 | B1.0\|REF99_V4\|472 | 837 | B1.0\|REF99_V4\|720 | 66 | 125 | 59 | 27 | | | | | | | | |
| 391 | 880 | B1.0\|REF99_V4\|472 | 713 | B1.0\|REF99_V4\|754 | 66 | 76 | 48 | 16 | | | | | | | | |
| 392 | 880 | B1.0\|REF99_V4\|472 | 1007 | B1.0\|REF99_V4\|9526 | 66 | 83 | 51 | 18 | | | | | | | | |
| 393 | 69 | B1.0\|REF99_V4\|506 | 1012 | B1.0\|REF99_V4\|597 | 58 | 73 | 54 | 14 | | | | | | | | |
| 394 | 69 | B1.0\|REF99_V4\|506 | 837 | B1.0\|REF99_V4\|720 | 58 | 125 | 57 | 24 | | | | | | | | |
| 395 | 69 | B1.0\|REF99_V4\|506 | 713 | B1.0\|REF99_V4\|754 | 58 | 76 | 48 | 14 | | | | | | | | |
| 396 | 69 | B1.0\|REF99_V4\|506 | 915 | B1.0\|REF99_V4\|884 | 58 | 55 | 43 | 10 | | | | | | | | |
| 397 | 69 | B1.0\|REF99_V4\|506 | 1007 | B1.0\|REF99_V4\|9526 | 58 | 83 | 52 | 16 | | | | | | | | |
| 398 | 818 | B1.0\|REF99_V4\|531 | 837 | B1.0\|REF99_V4\|720 | 81 | 125 | 64 | 33 | | | | | | | | |
| 399 | 702 | B1.0\|REF99_V4\|5579 | 1134 | B1.0\|REF99_V4\|986 | 67 | 79 | 56 | 17 | | | | | 67 | 63 | 56 | 19 |
| 400 | 1012 | B1.0\|REF99_V4\|597 | 837 | B1.0\|REF99_V4\|720 | 73 | 125 | 73 | 30 | | | | | | | | |
| 401 | 1012 | B1.0\|REF99_V4\|597 | 713 | B1.0\|REF99_V4\|754 | 73 | 76 | 60 | 18 | | | | | | | | |
| 402 | 1012 | B1.0\|REF99_V4\|597 | 915 | B1.0\|REF99_V4\|884 | 73 | 55 | 51 | 13 | | | | | | | | |
| 403 | 1012 | B1.0\|REF99_V4\|597 | 1007 | B1.0\|REF99_V4\|9526 | 73 | 83 | 66 | 20 | | | | | | | | |
| 404 | 319 | B1.0\|REF99_V4\|70731 | 1007 | B1.0\|REF99_V4\|9526 | 45 | 83 | 43 | 12 | | | | | | | | |
| 405 | 837 | B1.0\|REF99_V4\|720 | 713 | B1.0\|REF99_V4\|754 | 125 | 76 | 65 | 31 | | | | | | | | |
| 406 | 837 | B1.0\|REF99_V4\|720 | 915 | B1.0\|REF99_V4\|884 | 125 | 55 | 55 | 23 | | | | | | | | |
| 407 | 837 | B1.0\|REF99_V4\|720 | 1007 | B1.0\|REF99_V4\|9526 | 125 | 83 | 77 | 34 | | | | | | | | |

TABLE 10-continued

| A PAIR | B Endophyte 1 (SEQ ID NO:) | C Endophyte 1 (OTU) | D Endophyte 2 (SEQ ID NO:) | E Endophyte 2 (OTU) | F Bacteria - all | | | | G Bacteria - roots | | | | H Bacteria - seeds | | | |
|---|---|---|---|---|---|---|---|---|---|---|---|---|---|---|---|---|
| | | | | | N1 | N2 | OC | EC | N1 | N2 | OC | EC | N1 | N2 | OC | EC |
| 408 | 713 | B1.0\|REF99_V4\|754 | 915 | B1.0\|REF99_V4\|884 | 76 | 55 | 52 | 14 | | | | | | | | |
| 409 | 713 | B1.0\|REF99_V4\|754 | 1007 | B1.0\|REF99_V4\|9526 | 76 | 83 | 59 | 21 | | | | | | | | |
| 410 | 915 | B1.0\|REF99_V4\|884 | 1007 | B1.0\|REF99_V4\|9526 | 55 | 83 | 52 | 15 | | | | | | | | |
| 413 | 1108 | B1.0\|REF97_V4\|1 | 1113 | B1.0\|REF99_V4\|52497 | | | | | | | | | 49 | 35 | 33 | 8 |
| 421 | 1089 | B1.0\|REF97_V4\|127 | 1112 | B1.0\|REF99_V4\|14460 | | | | | | | | | 98 | 129 | 81 | 56 |
| 429 | 1098 | B1.0\|REF99_V4\|171 | 1104 | B1.0\|REF99_V4\|122519 | | | | | | | | | 43 | 51 | 37 | 10 |
| 464 | 1110 | B1.0\|REF99_V4\|108549 | 1113 | B1.0\|REF99_V4\|52497 | | | | | | | | | 55 | 35 | 32 | 9 |
| 530 | 1191 | B1.0\|REF97_V4\|150716 | 510 | B1.0\|REF97_V4\|8981 | | | | | | | | | 81 | 60 | 45 | 21 |
| 532 | 1191 | B1.0\|REF97_V4\|150716 | 510 | B1.0\|REF97_V4\|8981 | | | | | | | | | 81 | 69 | 50 | 25 |
| 607 | 510 | B1.0\|REF97_V4\|8981 | 1191 | B1.0\|REF97_V4\|150716 | | | | | | | | | 60 | 86 | 48 | 23 |
| 667 | 839 | B1.0\|REF99_V4\|1186 | 1221 | B1.0\|REF99_V4\|2512 | | | | | 38 | 37 | 26 | 18 | | | | |
| 676 | 1104 | B1.0\|REF99_V4\|122519 | 1092 | B1.0\|REF99_V4\|76 | | | | | | | | | 51 | 65 | 39 | 15 |
| 709 | 939 | B1.0\|REF99_V4\|1317 | 683 | B1.0\|REF99_V4\|2385 | | | | | 45 | 42 | 32 | 24 | | | | |
| 739 | 1091 | B1.0\|REF99_V4\|15 | 1092 | B1.0\|REF99_V4\|76 | | | | | | | | | 72 | 65 | 47 | 21 |
| 879 | 959 | B1.0\|REF97_V4\|126 | 1089 | B1.0\|REF97_V4\|127 | | | | | 30 | 37 | 22 | 14 | | | | |
| 882 | 1171 | B1.0\|REF97_V4\|1639 | 1171 | B1.0\|REF97_V4\|1639 | | | | | 19 | 43 | 19 | 10 | | | | |
| 914 | 1184 | B1.0\|REF99_V4\|20510 | 845 | B1.0\|REF99_V4\|2959 | | | | | 38 | 33 | 24 | 16 | | | | |
| 921 | 1221 | B1.0\|REF99_V4\|2512 | 665 | B1.0\|REF99_V4\|446 | | | | | 37 | 37 | 28 | 17 | | | | |
| 925 | 961 | B1.0\|REF99_V4\|3580 | 853 | B1.0\|REF99_V4\|5965 | | | | | 42 | 31 | 25 | 17 | | | | |
| 933 | 1108 | B1.0\|REF97_V4\|1 | 1086 | B1.0\|REF99_V4\|25794 | | | | | | | | | 49 | 76 | 47 | 16 |
| 934 | 1089 | B1.0\|REF97_V4\|127 | 1088 | B1.0\|REF99_V4\|1703 | | | | | | | | | 98 | 120 | 77 | 52 |
| 936 | 1191 | B1.0\|REF97_V4\|150716 | 121 | B1.0\|REF99_V4\|1211 | | | | | | | | | 81 | 74 | 51 | 26 |
| 938 | 1191 | B1.0\|REF97_V4\|150716 | 1158 | B1.0\|REF99_V4\|1323 | | | | | | | | | 81 | 101 | 59 | 36 |
| 952 | 850 | B1.0\|REF99_V4\|11157 | 804 | B1.0\|REF99_V4\|1838 | | | | | | | | | 59 | 44 | 36 | 11 |
| 953 | 850 | B1.0\|REF99_V4\|11157 | 816 | B1.0\|REF99_V4\|21134 | | | | | | | | | 59 | 42 | 35 | 11 |
| 963 | 1191 | B1.0\|REF97_V4\|150716 | 510 | B1.0\|REF97_V4\|8981 | | | | | | | | | 86 | 69 | 52 | 26 |
| 968 | 684 | B1.0\|REF99_V4\|172 | 702 | B1.0\|REF99_V4\|5579 | | | | | | | | | 102 | 67 | 61 | 30 |
| 970 | 684 | B1.0\|REF99_V4\|172 | 1134 | B1.0\|REF99_V4\|986 | | | | | | | | | 102 | 63 | 56 | 28 |
| 971 | 804 | B1.0\|REF99_V4\|1838 | 816 | B1.0\|REF99_V4\|21134 | | | | | | | | | 44 | 42 | 32 | 8 |
| 973 | 1080 | B1.0\|REF99_V4\|19 | 1077 | B1.0\|REF99_V4\|209 | | | | | | | | | 61 | 91 | 49 | 25 |
| 977 | 1109 | B1.0\|REF99_V4\|25629 | 1094 | B1.0\|REF99_V4\|387 | | | | | | | | | 122 | 73 | 63 | 39 |
| 979 | 1086 | B1.0\|REF99_V4\|25794 | 1092 | B1.0\|REF99_V4\|76 | | | | | | | | | 76 | 65 | 47 | 22 |
| 1019 | 1248 | B1.0\|REF99_V4\|1792 | 1221 | B1.0\|REF99_V4\|2512 | | | | | 20 | 37 | 18 | 9 | | | | |
| 1028 | 529 | B1.0\|REF99_V4\|3983 | 506 | B1.0\|REF99_V4\|951 | | | | | 36 | 30 | 22 | 14 | | | | |
| 1035 | 1108 | B1.0\|REF97_V4\|1 | 1091 | B1.0\|REF99_V4\|15 | | | | | | | | | 49 | 72 | 41 | 16 |
| 1036 | 1108 | B1.0\|REF97_V4\|1 | 1097 | B1.0\|REF99_V4\|159716 | | | | | | | | | 49 | 44 | 40 | 10 |
| 1052 | 1110 | B1.0\|REF99_V4\|108549 | 1077 | B1.0\|REF99_V4\|209 | | | | | | | | | 55 | 91 | 46 | 22 |
| 1070 | 1097 | B1.0\|REF99_V4\|159716 | 1093 | B1.0\|REF99_V4\|29 | | | | | | | | | 44 | 64 | 40 | 12 |
| 1071 | 1097 | B1.0\|REF99_V4\|159716 | 1113 | B1.0\|REF99_V4\|52497 | | | | | | | | | 44 | 35 | 32 | 7 |
| 1080 | 1077 | B1.0\|REF99_V4\|209 | 1093 | B1.0\|REF99_V4\|29 | | | | | | | | | 91 | 64 | 50 | 26 |
| 1084 | 1086 | B1.0\|REF99_V4\|25794 | 1083 | B1.0\|REF99_V4\|26074 | | | | | | | | | 76 | 41 | 37 | 14 |
| 1091 | 1093 | B1.0\|REF99_V4\|29 | 1113 | B1.0\|REF99_V4\|52497 | | | | | | | | | 64 | 35 | 34 | 10 |
| 1382 | 939 | B1.0\|REF99_V4\|1317 | 1221 | B1.0\|REF99_V4\|2512 | | | | | 45 | 37 | 30 | 21 | | | | |
| 1692 | 665 | B1.0\|REF99_V4\|446 | 353 | B1.0\|REF99_V4\|9861 | | | | | 37 | 36 | 25 | 17 | | | | |
| 2399 | 717 | B1.0\|REF99_V4\|17223 | 826 | B1.0\|REF99_V4\|467 | | | | | | | | | 42 | 70 | 38 | 13 |
| 2452 | 826 | B1.0\|REF99_V4\|467 | 1199 | B1.0\|REF99_V4\|589 | | | | | | | | | 70 | 54 | 40 | 17 |
| 3090 | 1106 | B1.0\|REF97_V4\|66 | 1090 | B1.0\|REF99_V4\|79117 | | | | | 53 | 29 | 29 | 20 | | | | |
| 3093 | 850 | B1.0\|REF99_V4\|11157 | 845 | B1.0\|REF99_V4\|2959 | | | | | 34 | 33 | 24 | 14 | | | | |
| 3111 | 1089 | B1.0\|REF97_V4\|127 | 1109 | B1.0\|REF99_V4\|25629 | | | | | | | | | 98 | 122 | 78 | 53 |
| 3114 | 1106 | B1.0\|REF97_V4\|66 | 1112 | B1.0\|REF99_V4\|14460 | | | | | | | | | 75 | 129 | 69 | 43 |
| 3115 | 1106 | B1.0\|REF97_V4\|66 | 1109 | B1.0\|REF99_V4\|25629 | | | | | | | | | 75 | 122 | 64 | 40 |
| 3121 | 1091 | B1.0\|REF99_V4\|15 | 1081 | B1.0\|REF99_V4\|156009 | | | | | | | | | 72 | 67 | 47 | 21 |
| 3124 | 1081 | B1.0\|REF99_V4\|156009 | 1097 | B1.0\|REF99_V4\|159716 | | | | | | | | | 67 | 44 | 40 | 13 |
| 3125 | 1081 | B1.0\|REF99_V4\|156009 | 1080 | B1.0\|REF99_V4\|19 | | | | | | | | | 67 | 61 | 44 | 18 |
| 3127 | 1097 | B1.0\|REF99_V4\|159716 | 1080 | B1.0\|REF99_V4\|19 | | | | | | | | | 44 | 61 | 40 | 12 |
| 3128 | 1097 | B1.0\|REF99_V4\|159716 | 1083 | B1.0\|REF99_V4\|26074 | | | | | | | | | 44 | 41 | 31 | 8 |
| 3129 | 1080 | B1.0\|REF99_V4\|19 | 1083 | B1.0\|REF99_V4\|26074 | | | | | | | | | 61 | 41 | 35 | 11 |
| 3131 | 1108 | B1.0\|REF97_V4\|1 | 1081 | B1.0\|REF99_V4\|156009 | | | | | | | | | 49 | 67 | 44 | 15 |
| 3156 | 1191 | B1.0\|REF97_V4\|150716 | 1175 | B1.0\|REF99_V4\|284 | | | | | | | | | 81 | 78 | 52 | 28 |
| 3181 | 1158 | B1.0\|REF99_V4\|1323 | 1158 | B1.0\|REF99_V4\|1323 | | | | | | | | | 46 | 101 | 45 | 21 |
| 3182 | 1191 | B1.0\|REF97_V4\|150716 | 850 | B1.0\|REF99_V4\|11157 | | | | | | | | | 81 | 59 | 47 | 21 |
| 3183 | 1191 | B1.0\|REF97_V4\|150716 | 800 | B1.0\|REF99_V4\|156812 | | | | | | | | | 81 | 50 | 41 | 18 |
| 3184 | 1106 | B1.0\|REF97_V4\|66 | 1092 | B1.0\|REF99_V4\|76 | | | | | | | | | 75 | 65 | 45 | 22 |
| 3185 | 850 | B1.0\|REF99_V4\|11157 | 1191 | B1.0\|REF97_V4\|150716 | | | | | | | | | 59 | 86 | 46 | 22 |
| 3186 | 850 | B1.0\|REF99_V4\|11157 | 852 | B1.0\|REF99_V4\|298 | | | | | | | | | 59 | 42 | 34 | 11 |
| 3187 | 111 | B1.0\|REF99_V4\|1256 | 1191 | B1.0\|REF97_V4\|150716 | | | | | | | | | 67 | 86 | 49 | 25 |
| 3188 | 1191 | B1.0\|REF97_V4\|150716 | 1175 | B1.0\|REF99_V4\|284 | | | | | | | | | 86 | 78 | 54 | 30 |
| 3189 | 1081 | B1.0\|REF99_V4\|156009 | 1113 | B1.0\|REF99_V4\|52497 | | | | | | | | | 67 | 35 | 33 | 10 |
| 3190 | 800 | B1.0\|REF99_V4\|156812 | 852 | B1.0\|REF99_V4\|298 | | | | | | | | | 50 | 42 | 34 | 9 |
| 3191 | 717 | B1.0\|REF99_V4\|17223 | 1199 | B1.0\|REF99_V4\|589 | | | | | | | | | 42 | 54 | 33 | 10 |
| 3192 | 1080 | B1.0\|REF99_V4\|19 | 1092 | B1.0\|REF99_V4\|76 | | | | | | | | | 61 | 65 | 42 | 18 |
| 3193 | 816 | B1.0\|REF99_V4\|21134 | 644 | B1.0\|REF99_V4\|7232 | | | | | | | | | 42 | 41 | 31 | 8 |
| 3194 | 1175 | B1.0\|REF99_V4\|284 | 957 | B1.0\|REF99_V4\|921 | | | | | | | | | 78 | 80 | 51 | 28 |

TABLE 10-continued

| A PAIR | B Endophyte 1 (SEQ ID NO:) | C Endophyte 1 (OTU) | D Endophyte 2 (SEQ ID NO:) | E Endophyte 2 (OTU) | F Bacteria - all | | | | G Bacteria - roots | | | | H Bacteria - seeds | | | |
|---|---|---|---|---|---|---|---|---|---|---|---|---|---|---|---|---|
| | | | | | N1 | N2 | OC | EC | N1 | N2 | OC | EC | N1 | N2 | OC | EC |
| 3195 | 1092 | B1.0|REF99_V4|76 | 1090 | B1.0|REF99_V4|79117 | | | | | | | | | 65 | 74 | 44 | 21 |
| 3196 | 510 | B1.0|REF99_V4|8981 | 957 | B1.0|REF99_V4|921 | | | | | | | | | 69 | 80 | 48 | 24 |

Table 11: Pairs of Endophytes Useful for the Present Invention, as Identified by Co-Occurrence Analysis of Various Plant Samples.

Column A shows the pair number. Columns B and C show the SEQ ID NO: and OTU designation for endophyte 1 of a pair. Columns D and E show the SEQ ID NO: and OTU designation for endophyte 2 of a pair. Columns F, G, and H show the number of times microbes belonging to OTU1 occur in a sample (N1), the number of times microbes belonging to OTU2 occur in a sample (N2), the number of times the microbes co-occur in all the plant samples of the collection or a subgroup of those plant samples (OC), and the number of times microbes of those OTUs would be expected to co-occur (EC). In this table, "Fungi—all" represent a co-occurrence analysis using all of the plant samples of the collection to identify fungi that co-occur. "Fungi—roots" represent a co-occurrence analysis of community sequencing data obtained from roots samples only, to identify fungi that co-occur. "Fungi—seeds" represent a co-occurrence analysis of community sequencing data obtained from seed samples only, to identify fungi that co-occur.

TABLE 11

| A PAIR | B Endophyte 1 (SEQ ID NO:) | C Endophyte 1 (OTU) | D Endophyte 2 (SEQ ID NO:) | E Endophyte 2 (OTU) | F Fungi - all | | | | G Fungi - seeds | | | | H Fungi - roots | | | |
|---|---|---|---|---|---|---|---|---|---|---|---|---|---|---|---|---|
| | | | | | N1 | N2 | OC | EC | N1 | N2 | OC | EC | N1 | N2 | OC | EC |
| 3674 | 1673 | F1.0|SYM97_ITS1F|122 | 1515 | F1.0|SYM97_ITS1F|31 | 41 | 69 | 39 | 15 | | | | | | | | |
| 3675 | 1673 | F1.0|SYM97_ITS1F|122 | 1683 | F1.0|SYM97_ITS1F|51 | 41 | 46 | 31 | 10 | | | | | | | | |
| 3676 | 1673 | F1.0|SYM97_ITS1F|122 | 1682 | F1.0|SYM97_ITS1F|74 | 41 | 48 | 30 | 10 | | | | | | | | |
| 3677 | 1673 | F1.0|SYM97_ITS1F|122 | 1575 | F1.0|UDYN_ITS1F|37 | 41 | 60 | 35 | 13 | | | | | | | | |
| 3678 | 1515 | F1.0|SYM97_ITS1F|31 | 1683 | F1.0|SYM97_ITS1F|51 | 69 | 46 | 44 | 16 | | | | | | | | |
| 3679 | 1515 | F1.0|SYM97_ITS1F|31 | 1682 | F1.0|SYM97_ITS1F|74 | 69 | 48 | 44 | 17 | | | | | | | | |
| 3680 | 1515 | F1.0|SYM97_ITS1F|31 | 1681 | F1.0|SYM97_ITS1F|75 | 69 | 34 | 32 | 12 | | | | | | | | |
| 3681 | 1515 | F1.0|SYM97_ITS1F|31 | 1574 | F1.0|U97_ITS1F|479 | 69 | 51 | 45 | 18 | | | | | | | | |
| 3682 | 1515 | F1.0|SYM97_ITS1F|31 | 1575 | F1.0|UDYN_ITS1F|37 | 69 | 60 | 52 | 22 | | | | | | | | |
| 3683 | 1515 | F1.0|SYM97_ITS1F|31 | 1573 | F1.0|UDYN_ITS1F|60 | 69 | 45 | 41 | 16 | | | | | | | | |
| 3684 | 1515 | F1.0|SYM97_ITS1F|31 | 1557 | F1.0|UDYN_ITS1F|621 | 69 | 51 | 52 | 22 | | | | | | | | |
| 3685 | 1683 | F1.0|SYM97_ITS1F|51 | 1682 | F1.0|SYM97_ITS1F|74 | 46 | 48 | 37 | 11 | | | | | 46 | 48 | 37 | 28 |
| 3686 | 1683 | F1.0|SYM97_ITS1F|51 | 1681 | F1.0|SYM97_ITS1F|75 | 46 | 34 | 30 | 8 | | | | | 46 | 34 | 30 | 20 |
| 3687 | 1683 | F1.0|SYM97_ITS1F|51 | 1575 | F1.0|UDYN_ITS1F|37 | 46 | 60 | 35 | 14 | | | | | | | | |
| 3688 | 1683 | F1.0|SYM97_ITS1F|51 | 1557 | F1.0|UDYN_ITS1F|621 | 46 | 61 | 35 | 15 | | | | | | | | |
| 3689 | 1682 | F1.0|SYM97_ITS1F|74 | 1575 | F1.0|UDYN_ITS1F|37 | 48 | 60 | 35 | 15 | | | | | | | | |
| 3690 | 1682 | F1.0|SYM97_ITS1F|74 | 1557 | F1.0|UDYN_ITS1F|621 | 48 | 61 | 38 | 15 | | | | | | | | |
| 3691 | 1574 | F1.0|U97_ITS1F|479 | 1575 | F1.0|UDYN_ITS1F|37 | 51 | 60 | 46 | 16 | | | | | 51 | 58 | 46 | 37 |
| 3692 | 1574 | F1.0|U97_ITS1F|479 | 1573 | F1.0|UDYN_ITS1F|60 | 51 | 45 | 35 | 12 | | | | | | | | |
| 3693 | 1574 | F1.0|U97_ITS1F|479 | 1557 | F1.0|UDYN_ITS1F|621 | 51 | 61 | 41 | 16 | | | | | | | | |
| 3694 | 1655 | F1.0|U97_ITS1F|628 | 1533 | F1.0|UDYN_ITS1F|458 | 51 | 42 | 36 | 11 | 47 | 42 | 36 | 17 | | | | |
| 3695 | 1575 | F1.0|UDYN_ITS1F|37 | 1573 | F1.0|UDYN_ITS1F|60 | 60 | 45 | 42 | 14 | | | | | 58 | 44 | 42 | 32 |
| 3696 | 1575 | F1.0|UDYN_ITS1F|37 | 1557 | F1.0|UDYN_ITS1F|621 | 60 | 61 | 45 | 19 | | | | | | | | |
| 3697 | 1672 | F1.0|UDYN_ITS1F|451 | 1655 | F1.0|U97_ITS1F|628 | 125 | 117 | 105 | 76 | | | | | 30 | 23 | 20 | 9 |
| 3698 | 1523 | F1.0|UDYN_ITS1F|486 | 1481 | F1.0|UDYN_ITS1F|548 | 69 | 86 | 52 | 31 | | | | | | | | |
| 3699 | 1523 | F1.0|UDYN_ITS1F|486 | 1581 | F1.0|UDYN_ITS1F|84 | 69 | 66 | 51 | 24 | 69 | 64 | 51 | 39 | | | | |
| 3700 | 1596 | F1.0|UDYN_ITS1F|508 | 1592 | F1.0|UDYN_ITS1F|627 | 47 | 29 | 29 | 7 | 46 | 29 | 29 | 12 | | | | |
| 3701 | 1596 | F1.0|UDYN_ITS1F|508 | 1581 | F1.0|UDYN_ITS1F|84 | 47 | 66 | 36 | 16 | | | | | | | | |
| 3702 | 1573 | F1.0|UDYN_ITS1F|60 | 1557 | F1.0|UDYN_ITS1F|621 | 45 | 61 | 37 | 14 | | | | | | | | |
| 3733 | 1683 | F1.0|SYM97_ITS1F|51 | 1521 | F1.0|UDYN_ITS1F|73 | | | | | | | | | 46 | 41 | 32 | 24 |
| 3738 | 1681 | F1.0|SYM97_ITS1F|75 | 1521 | F1.0|UDYN_ITS1F|73 | | | | | | | | | 34 | 41 | 26 | 18 |
| 3739 | 1576 | F1.0|U97_ITS1F|112 | 1576 | F1.0|UDYN_ITS1F|112 | | | | | | | | | 26 | 34 | 22 | 11 |
| 3740 | 1591 | F1.0|U97_ITS1F|3 | 1523 | F1.0|U97_ITS1F|486 | | | | | 23 | 18 | 15 | 4 | | | | |
| 3741 | 1591 | F1.0|U97_ITS1F|3 | 1591 | F1.0|UDYN_ITS1F|3 | | | | | 23 | 31 | 21 | 6 | | | | |
| 3742 | 1595 | F1.0|U97_ITS1F|38 | 1595 | F1.0|UDYN_ITS1F|38 | | | | | | | | | 21 | 20 | 15 | 5 |
| 3761 | 1514 | F1.0|SYM97_ITS1F|369 | 1493 | F1.0|U97_ITS1F|378 | | | | | | | | | 21 | 28 | 16 | 7 |
| 3764 | 1529 | F1.0|U97_ITS1F|80 | 1529 | F1.0|UDYN_ITS1F|80 | | | | | | | | | 12 | 18 | 11 | 3 |
| 3768 | 1587 | F1.0|UDYN_ITS1F|1 | 1581 | F1.0|UDYN_ITS1F|84 | | | | | 88 | 64 | 63 | 49 | | | | |
| 3769 | 1586 | F1.0|UDYN_ITS1F|110 | 1589 | F1.0|UDYN_ITS1F|83 | | | | | 33 | 38 | 24 | 11 | | | | |
| 3772 | 1531 | F1.0|U97_ITS1F|12 | 1531 | F1.0|UDYN_ITS1F|12 | | | | | | | | | 15 | 18 | 13 | 3 |
| 3822 | 1629 | F1.0|U97_ITS1F|603 | 1629 | F1.0|UDYN_ITS1F|603 | | | | | | | | | 17 | 22 | 14 | 5 |
| 3896 | 1593 | F1.0|UDYN_ITS1F|16 | 1596 | F1.0|UDYN_ITS1F|508 | | | | | 25 | 46 | 25 | 10 | | | | |
| 3897 | 1593 | F1.0|UDYN_ITS1F|16 | 1605 | F1.0|UDYN_ITS1F|6 | | | | | 25 | 29 | 21 | 6 | | | | |
| 3898 | 1593 | F1.0|UDYN_ITS1F|16 | 1592 | F1.0|UDYN_ITS1F|627 | | | | | 25 | 29 | 23 | 6 | | | | |

TABLE 11-continued

| A PAIR | B Endophyte 1 (SEQ ID NO:) | C Endophyte 1 (OTU) | D Endophyte 2 (SEQ ID NO:) | E Endophyte 2 (OTU) | F Fungi - all | | | | G Fungi - seeds | | | | H Fungi - roots | | | |
|---|---|---|---|---|---|---|---|---|---|---|---|---|---|---|---|---|
| | | | | | N1 | N2 | OC | EC | N1 | N2 | OC | EC | N1 | N2 | OC | EC |
| 3899 | 1596 | F1.0|UDYN__ITS1F|508 | 1605 | F1.0|UDYN__ITS1F|6 | | | | | 46 | 29 | 24 | 12 | | | | |
| 3900 | 1605 | F1.0|UDYN__ITS1F|6 | 1592 | F1.0|UDYN__ITS1F|627 | | | | | 29 | 29 | 23 | 7 | | | | |
| 3905 | 1673 | F1.0|SYM97__ITS1F|122 | 1654 | F1.0|SYM97__ITS1F|264 | | | | | | | | | 41 | 17 | 17 | 9 |
| 3907 | 1518 | F1.0|U97__ITS1F|502 | 1518 | F1.0|UDYN__ITS1F|502 | | | | | 16 | 22 | 15 | 3 | | | | |
| 3908 | 1518 | F1.0|U97__ITS1F|502 | 1628 | F1.0|UDYN__ITS1F|77 | | | | | 16 | 24 | 15 | 3 | | | | |
| 3909 | 1655 | F1.0|U97__ITS1F|628 | 1488 | F1.0|UDYN__ITS1F|550 | | | | | 47 | 26 | 23 | 11 | | | | |
| 3910 | 1628 | F1.0|U97__ITS1F|77 | 1518 | F1.0|UDYN__ITS1F|502 | | | | | 24 | 22 | 17 | 5 | | | | |
| 3911 | 1628 | F1.0|U97__ITS1F|77 | 1628 | F1.0|UDYN__ITS1F|77 | | | | | 24 | 24 | 21 | 5 | | | | |
| 3912 | 1594 | F1.0|UDYN__ITS1F|198 | 1585 | F1.0|UDYN__ITS1F|367 | | | | | 17 | 16 | 15 | 2 | | | | |
| 3913 | 1518 | F1.0|UDYN__ITS1F|502 | 1628 | F1.0|UDYN__ITS1F|77 | | | | | 22 | 24 | 18 | 5 | | | | |

Table 12: Pairs of Endophytes Useful for the Present Invention, as Identified by Co-Occurrence Analysis of Various Plant Samples.

Column A shows the pair number. Columns B and C show the SEQ ID NO: and OTU designation for endophyte 1 of a pair. Columns D and E show the SEQ ID NO: and OTU designation for endophyte 2 of a pair. Columns F, G, H, I, J, and K show the number of times microbes belonging to OTU1 occur in a sample (N1), the number of times microbes belonging to OTU2 occur in a sample (N2), the number of times the microbes co-occur in all the plant samples of the collection or a subgroup of those plant samples (OC), and the number of times microbes of those OTUs would be expected to co-occur (EC). In this table, "Bacteria—cultivated" represents a co-occurrence analysis using all cultivated plant samples of the collection, to identify bacteria that co-occur in these samples. "Bacteria—cultivated, roots" represents a co-occurrence analysis using only root samples from the cultivated plant samples of the collection, to identify bacteria that co-occur in these samples. "Bacteria—cultivated, seeds" represents a co-occurrence analysis using only seed samples from the cultivated plant samples of the collection, to identify bacteria that co-occur in these samples. "Bacteria—wild" represents a co-occurrence analysis using all wild plant samples of the collection, to identify bacteria that co-occur in these samples. "Bacteria—wild, roots" represents a co-occurrence analysis using only root samples from the wild plant samples of the collection, to identify bacteria that co-occur in these samples. "Bacteria—wild, seeds" represents a co-occurrence analysis using only seed samples from the wild plant samples of the collection, to identify bacteria that co-occur in these samples.

TABLE 12

| PAIR | B Endophyte 1 (SEQ ID NO:) | C Endophyte 1 (OTU) | D Endophyte 2 (SEQ ID NO:) | E Endophyte 2 (OTU) | F Bacteria - cultivated | | | | G Bacteria - cultivated, roots | | | | H Bacteria - cultivated, seeds | | | | I Bacteria - wild | | | | J Bacteria - wild, roots | | | | K Bacteria - wild, seeds | | | |
|---|---|---|---|---|---|---|---|---|---|---|---|---|---|---|---|---|---|---|---|---|---|---|---|---|---|---|---|---|
| A | | | | | N1 | N2 | OC | EC | N1 | N2 | OC | EC | N1 | N2 | OC | EC | N1 | N2 | OC | EC | N1 | N2 | OC | EC | N1 | N2 | OC | EC |
| 1 | 1108 | B1.0|REF97_V4|1 | 1110 | B1.0|REF99_V4|108549 | | | | | | | | | 16 | 15 | 12 | 3 | 39 | 38 | 32 | 9 | | | | | 32 | 38 | 32 | 10 |
| 2 | 1108 | B1.0|REF97_V4|1 | 1080 | B1.0|REF99_V4|419 | | | | | | | | | | | | | 39 | 39 | 33 | 10 | | | | | 32 | 38 | 32 | 10 |
| 3 | 1108 | B1.0|REF97_V4|1 | 1093 | B1.0|REF99_V4|429 | | | | | | | | | 16 | 17 | 12 | 3 | 32 | 44 | 33 | 11 | | | | | 32 | 43 | 32 | 11 |
| 4 | 137 | B1.0|REF97_V4|11 | 974 | B1.0|REF99_V4|2831 | | | | | | | | | | | | | 32 | 37 | 25 | 7 | | | | | | | | |
| 5 | 137 | B1.0|REF97_V4|11 | 916 | B1.0|REF99_V4|3675 | | | | | | | | | | | | | 32 | 33 | 24 | 7 | | | | | | | | |
| 6 | 137 | B1.0|REF97_V4|11 | 137 | B1.0|REF99_V4|11 | | | | | | | | | | | | | 32 | 60 | 31 | 12 | | | | | | | | |
| 7 | 137 | B1.0|REF97_V4|11 | 974 | B1.0|REF99_V4|2831 | | | | | | | | | | | | | 32 | 37 | 25 | 7 | | | | | | | | |
| 8 | 137 | B1.0|REF97_V4|11 | 916 | B1.0|REF99_V4|3675 | | | | | | | | | | | | | 32 | 37 | 24 | 7 | | | | | | | | |
| 9 | 137 | B1.0|REF97_V4|11 | 1012 | B1.0|REF99_V4|597 | | | | | | | | | | | | | 32 | 34 | 25 | 7 | | | | | | | | |
| 10 | 137 | B1.0|REF97_V4|11 | 1007 | B1.0|REF99_V4|9526 | | | | | | | | | | | | | 32 | 41 | 25 | 8 | | | | | | | | |
| 11 | 137 | B1.0|REF97_V4|11 | 1095 | B1.0|REF99_V4|54497 | | | | | | | | | | | | | 83 | 64 | 59 | 33 | | | | | 68 | 64 | 59 | 35 |
| 12 | 1089 | B1.0|REF97_V4|127 | 111 | B1.0|REF99_V4|11256 | | | | | | | | | | | | | 50 | 44 | 35 | 14 | | | | | 50 | 44 | 35 | 18 |
| 13 | 1191 | B1.0|REF97_V4|150716 | 1191 | B1.0|REF99_V4|150716 | 28 | 32 | 28 | 7 | | | | | 28 | 31 | 28 | 10 | 50 | 53 | 45 | 17 | | | | | 50 | 53 | 45 | 22 |
| 14 | 1191 | B1.0|REF97_V4|150716 | 972 | B1.0|REF99_V4|218 | 28 | 32 | 23 | 7 | | | | | 28 | 32 | 23 | 11 | 50 | 63 | 39 | 20 | | | | | 50 | 63 | 39 | 26 |
| 15 | 1191 | B1.0|REF97_V4|150716 | 957 | B1.0|REF99_V4|921 | | | | | | | | | 28 | 32 | 22 | 11 | 50 | 48 | 37 | 15 | | | | | 50 | 46 | 37 | 19 |
| 16 | 1011 | B1.0|REF97_V4|2104 | 974 | B1.0|REF99_V4|2831 | | | | | | | | | | | | | 26 | 37 | 26 | 6 | | | | | | | | |
| 17 | 1011 | B1.0|REF97_V4|2104 | 916 | B1.0|REF99_V4|3675 | | | | | | | | | | | | | 26 | 33 | 24 | 5 | | | | | | | | |
| 18 | 1011 | B1.0|REF97_V4|2104 | 1011 | B1.0|REF99_V4|2104 | | | | | | | | | | | | | 26 | 32 | 25 | 5 | | | | | | | | |
| 19 | 1011 | B1.0|REF97_V4|2104 | 789 | B1.0|REF99_V4|2172 | | | | | | | | | | | | | 26 | 51 | 25 | 8 | | | | | | | | |
| 20 | 1011 | B1.0|REF97_V4|2104 | 974 | B1.0|REF99_V4|2831 | | | | | | | | | | | | | 26 | 37 | 26 | 6 | | | | | | | | |
| 21 | 1011 | B1.0|REF97_V4|2104 | 916 | B1.0|REF99_V4|3675 | | | | | | | | | | | | | 26 | 37 | 26 | 6 | | | | | | | | |
| 22 | 1011 | B1.0|REF97_V4|2104 | 1012 | B1.0|REF99_V4|597 | | | | | | | | | | | | | 26 | 34 | 24 | 6 | | | | | | | | |
| 23 | 1011 | B1.0|REF97_V4|2104 | 713 | B1.0|REF99_V4|754 | | | | | | | | | | | | | 26 | 37 | 23 | 6 | | | | | | | | |
| 24 | 1011 | B1.0|REF97_V4|2104 | 1007 | B1.0|REF99_V4|9526 | | | | | | | | | | | | | 26 | 41 | 23 | 7 | | | | | | | | |
| 25 | 1011 | B1.0|REF97_V4|2104 | 615 | B1.0|REF99_V4|3374 | | | | | | | | | | | | | 37 | 21 | 21 | 5 | | | | | | | | |
| 26 | 974 | B1.0|REF97_V4|2831 | 916 | B1.0|REF99_V4|3675 | 42 | 37 | 33 | 12 | | | | | | | | | 37 | 33 | 33 | 8 | | | | | | | | |
| 27 | 974 | B1.0|REF97_V4|2831 | 837 | B1.0|REF99_V4|720 | 42 | 43 | 39 | 14 | | | | | | | | | 37 | 83 | 35 | 19 | | | | | | | | |
| 28 | 974 | B1.0|REF97_V4|2831 | 1007 | B1.0|REF99_V4|9526 | 42 | 31 | 30 | 10 | | | | | | | | | 37 | 25 | 25 | 6 | | | | | | | | |
| 29 | 974 | B1.0|REF97_V4|2831 | 137 | B1.0|REF99_V4|11 | 42 | 53 | 41 | 18 | | | | | | | | | 37 | 32 | 28 | 7 | | | | | | | | |
| 30 | 974 | B1.0|REF97_V4|2831 | 884 | B1.0|REF99_V4|1164 | 42 | 30 | 30 | 10 | | | | | | | | | 37 | 33 | 22 | 7 | | | | | | | | |
| 31 | 974 | B1.0|REF97_V4|2831 | 959 | B1.0|REF99_V4|126 | 42 | 37 | 37 | 12 | | | | | | | | | 37 | 22 | 22 | 5 | | | | | | | | |
| 32 | 974 | B1.0|REF97_V4|2831 | 886 | B1.0|REF99_V4|1287 | 42 | 46 | 29 | 15 | | | | | | | | | 37 | 51 | 30 | 12 | | | | | | | | |
| 33 | 974 | B1.0|REF97_V4|2831 | 71 | B1.0|REF99_V4|1351 | 42 | 24 | 24 | 8 | | | | | | | | | 37 | 31 | 25 | 10 | | | | | | | | |
| 34 | 974 | B1.0|REF97_V4|2831 | 648 | B1.0|REF99_V4|14 | 42 | 38 | 36 | 13 | | | | | | | | | 37 | 42 | 30 | 11 | | | | | | | | |
| 35 | 974 | B1.0|REF97_V4|2831 | 739 | B1.0|REF99_V4|1562 | 42 | 78 | 42 | 26 | | | | | | | | | 37 | 60 | 37 | 14 | | | | | | | | |
| 36 | 974 | B1.0|REF97_V4|2831 | 116 | B1.0|REF99_V4|1567 | 42 | 35 | 33 | 12 | | | | | | | | | 37 | 24 | 24 | 6 | | | | | | | | |
| 37 | 974 | B1.0|REF97_V4|2831 | 1171 | B1.0|REF99_V4|1639 | 42 | 21 | 21 | 7 | | | | | | | | | | | | | | | | | | | | |
| 38 | 974 | B1.0|REF97_V4|2831 | 1180 | B1.0|REF99_V4|166 | 42 | 46 | 29 | 15 | | | | | | | | | 37 | 32 | 32 | 7 | | | | | | | | |
| 39 | 974 | B1.0|REF97_V4|2831 | 889 | B1.0|REF99_V4|185 | 42 | 31 | 25 | 10 | | | | | | | | | 37 | 83 | 35 | 19 | | | | | | | | |
| 40 | 974 | B1.0|REF97_V4|2831 | 656 | B1.0|REF99_V4|191 | 42 | 34 | 27 | 11 | | | | | | | | | 37 | 25 | 25 | 6 | | | | | | | | |
| 41 | 974 | B1.0|REF97_V4|2831 | 1011 | B1.0|REF99_V4|2104 | 42 | 30 | 30 | 10 | | | | | | | | | 37 | 32 | 28 | 7 | | | | | | | | |
| 42 | 974 | B1.0|REF97_V4|2831 | 789 | B1.0|REF99_V4|2172 | 42 | 42 | 39 | 14 | | | | | | | | | 37 | 22 | 22 | 5 | | | | | | | | |
| 43 | 974 | B1.0|REF97_V4|2831 | 1011 | B1.0|REF99_V4|2104 | 42 | 30 | 30 | 10 | | | | | | | | | 37 | 51 | 30 | 12 | | | | | | | | |
| 44 | 974 | B1.0|REF97_V4|2831 | 789 | B1.0|REF99_V4|2172 | 42 | 39 | 22 | 7 | | | | | | | | | 37 | 32 | 30 | 10 | | | | | | | | |
| 45 | 974 | B1.0|REF97_V4|2831 | 683 | B1.0|REF99_V4|2385 | 42 | 22 | 22 | 7 | | | | | | | | | 37 | 51 | 35 | 12 | | | | | | | | |
| 46 | 974 | B1.0|REF97_V4|2831 | 810 | B1.0|REF99_V4|250 | 42 | 39 | 39 | 13 | | | | | | | | | 37 | 22 | 22 | 5 | | | | | | | | |

TABLE 12-continued

| PAIR | Endophyte 1 (SEQ ID NO:) | Endophyte 1 (OTU) | Endophyte 2 (SEQ ID NO:) | Endophyte 2 (OTU) | F Bacteria - cultivated | | | | G Bacteria - cultivated, roots | | | | H Bacteria - cultivated, seeds | | | | I Bacteria - wild | | | | J Bacteria - wild, roots | | | | K Bacteria - wild, seeds | | | |
|---|---|---|---|---|---|---|---|---|---|---|---|---|---|---|---|---|---|---|---|---|---|---|---|---|---|---|---|---|
| A | B | C | D | E | N1 | N2 | OC | EC | N1 | N2 | OC | EC | N1 | N2 | OC | EC | N1 | N2 | OC | EC | N1 | N2 | OC | EC | N1 | N2 | OC | EC |
| 49 | 974 | B1.0REF97_V42831 | 131 | B1.0REF99_V41251 | 42 | 33 | 29 | 11 | | | | | | | | | 37 | 30 | 24 | 7 | | | | | | | | |
| 50 | 974 | B1.0REF97_V42831 | 943 | B1.0REF99_V426030 | 42 | 31 | 31 | 10 | | | | | | | | | 37 | 32 | 32 | 7 | | | | | | | | |
| 51 | 974 | B1.0REF97_V42831 | 974 | B1.0REF99_V42831 | 42 | 42 | 42 | 14 | | | | | | | | | 37 | 37 | 37 | 9 | | | | | | | | |
| 52 | 974 | B1.0REF97_V42831 | 615 | B1.0REF99_V43374 | 42 | 34 | 34 | 11 | | | | | | | | | 37 | 30 | 30 | 7 | | | | | | | | |
| 53 | 974 | B1.0REF97_V42831 | 963 | B1.0REF99_V433855 | 42 | 27 | 27 | 9 | | | | | | | | | 37 | 31 | 27 | 7 | | | | | | | | |
| 54 | 974 | B1.0REF97_V42831 | 961 | B1.0REF99_V43580 | 42 | 21 | 21 | 7 | | | | | | | | | 37 | 21 | 21 | 5 | | | | | | | | |
| 55 | 974 | B1.0REF97_V42831 | 916 | B1.0REF99_V43675 | 42 | 40 | 40 | 13 | | | | | | | | | 37 | 37 | 37 | 9 | | | | | | | | |
| 56 | 974 | B1.0REF97_V42831 | 945 | B1.0REF99_V4442 | 42 | 27 | 27 | 9 | | | | | | | | | | | | | | | | | | | | |
| 57 | 974 | B1.0REF97_V42831 | 880 | B1.0REF99_V4472 | 42 | 31 | 31 | 10 | | | | | | | | | 37 | 31 | 26 | 7 | | | | | | | | |
| 58 | 974 | B1.0REF97_V42831 | 69 | B1.0REF99_V4506 | 42 | 25 | 24 | 8 | | | | | | | | | 37 | 33 | 32 | 8 | | | | | | | | |
| 59 | 974 | B1.0REF97_V42831 | 60 | B1.0REF99_V4514 | 42 | 23 | 23 | 8 | | | | | | | | | | | | | | | | | | | | |
| 60 | 974 | B1.0REF97_V42831 | 1012 | B1.0REF99_V4597 | 42 | 39 | 39 | 13 | | | | | | | | | 37 | 34 | 34 | 8 | | | | | | | | |
| 61 | 974 | B1.0REF97_V42831 | 319 | B1.0REF99_V470731 | 42 | 24 | 24 | 8 | | | | | | | | | 37 | 21 | 21 | 5 | | | | | | | | |
| 62 | 974 | B1.0REF97_V42831 | 837 | B1.0REF99_V4720 | 42 | 55 | 42 | 18 | | | | | | | | | 37 | 69 | 37 | 16 | | | | | | | | |
| 63 | 974 | B1.0REF97_V42831 | 713 | B1.0REF99_V4754 | 42 | 36 | 34 | 12 | | | | | | | | | 37 | 37 | 31 | 9 | | | | | | | | |
| 64 | 974 | B1.0REF97_V42831 | 915 | B1.0REF99_V4884 | 42 | 27 | 27 | 9 | | | | | | | | | 37 | 28 | 28 | 7 | | | | | | | | |
| 65 | 974 | B1.0REF97_V42831 | 1007 | B1.0REF99_V49526 | 42 | 42 | 39 | 14 | | | | | | | | | 37 | 41 | 33 | 10 | | | | | | | | |
| 68 | 974 | B1.0REF97_V42831 | 1011 | B1.0REF99_V42104 | | | | | | | | | | | | | 37 | 32 | 21 | 4 | | | | | | | | |
| 69 | 615 | B1.0REF97_V43374 | 974 | B1.0REF99_V42831 | | | | | | | | | | | | | 37 | 37 | 21 | 5 | | | | | | | | |
| 70 | 615 | B1.0REF97_V43374 | 615 | B1.0REF99_V43374 | | | | | | | | | | | | | 21 | 30 | 20 | 4 | | | | | | | | |
| 71 | 615 | B1.0REF97_V43374 | 916 | B1.0REF99_V43675 | | | | | | | | | | | | | 21 | 37 | 21 | 5 | | | | | | | | |
| 72 | 615 | B1.0REF97_V43374 | 1012 | B1.0REF99_V4597 | | | | | | | | | | | | | 21 | 34 | 21 | 5 | | | | | | | | |
| 73 | 615 | B1.0REF97_V43374 | 837 | B1.0REF99_V4720 | | | | | | | | | | | | | 33 | 32 | 24 | 7 | | | | | | | | |
| 74 | 615 | B1.0REF97_V43374 | 1007 | B1.0REF97_V49526 | 37 | 43 | 34 | 13 | | | | | | | | | 33 | 60 | 33 | 12 | | | | | | | | |
| 75 | 615 | B1.0REF97_V43374 | 137 | B1.0REF97_V411 | 37 | 31 | 29 | 9 | | | | | | | | | 33 | 24 | 21 | 5 | | | | | | | | |
| 76 | 916 | B1.0REF97_V43675 | 884 | B1.0REF99_V41164 | 37 | 53 | 36 | 15 | | | | | | | | | | | | | | | | | | | | |
| 77 | 916 | B1.0REF97_V43675 | 959 | B1.0REF99_V4126 | 37 | 30 | 27 | 9 | | | | | | | | | | | | | | | | | | | | |
| 78 | 916 | B1.0REF97_V43675 | 886 | B1.0REF99_V41287 | 37 | 37 | 33 | 11 | | | | | | | | | | | | | | | | | | | | |
| 79 | 916 | B1.0REF97_V43675 | 71 | B1.0REF99_V41351 | 37 | 24 | 23 | 7 | | | | | | | | | | | | | | | | | | | | |
| 80 | 916 | B1.0REF97_V43675 | 648 | B1.0REF99_V4114 | 37 | 38 | 32 | 11 | | | | | | | | | 33 | 32 | 28 | 7 | | | | | | | | |
| 81 | 916 | B1.0REF97_V43675 | 116 | B1.0REF99_V41567 | 37 | 78 | 37 | 23 | | | | | | | | | | | | | | | | | | | | |
| 82 | 916 | B1.0REF97_V43675 | 1171 | B1.0REF99_V41639 | 37 | 35 | 30 | 10 | | | | | | | | | 33 | 32 | 26 | 7 | | | | | | | | |
| 83 | 916 | B1.0REF97_V43675 | 656 | B1.0REF99_V4191 | 37 | 21 | 20 | 6 | | | | | | | | | 33 | 22 | 21 | 5 | | | | | | | | |
| 84 | 916 | B1.0REF97_V43675 | 1011 | B1.0REF99_V42104 | 37 | 42 | 37 | 12 | | | | | | | | | 33 | 42 | 26 | 9 | | | | | | | | |
| 85 | 916 | B1.0REF97_V43675 | 789 | B1.0REF99_V42172 | 37 | 30 | 29 | 9 | | | | | | | | | 33 | 32 | 28 | 7 | | | | | | | | |
| 86 | 916 | B1.0REF97_V43675 | 810 | B1.0REF99_V4250 | 37 | 42 | 35 | 12 | | | | | | | | | 33 | 51 | 31 | 11 | | | | | | | | |
| 87 | 916 | B1.0REF97_V43675 | 131 | B1.0REF99_V4251 | 37 | 39 | 34 | 11 | | | | | | | | | | | | | | | | | | | | |
| 88 | 916 | B1.0REF97_V43675 | 943 | B1.0REF99_V426030 | 37 | 33 | 33 | 10 | | | | | | | | | | | | | | | | | | | | |
| 89 | 916 | B1.0REF97_V43675 | 974 | B1.0REF99_V42831 | 37 | 31 | 31 | 9 | | | | | | | | | 33 | 32 | 29 | 7 | | | | | | | | |
| 90 | 916 | B1.0REF97_V43675 | 615 | B1.0REF99_V43374 | 37 | 42 | 37 | 12 | | | | | | | | | 33 | 37 | 33 | 8 | | | | | | | | |
| 91 | 916 | B1.0REF97_V43675 | 963 | B1.0REF99_V433855 | 37 | 34 | 30 | 10 | | | | | | | | | 33 | 30 | 26 | 6 | | | | | | | | |
| 92 | 916 | B1.0REF97_V43675 | 916 | B1.0REF99_V43675 | 37 | 27 | 25 | 8 | | | | | | | | | 33 | 31 | 24 | 6 | | | | | | | | |
| 93 | 916 | B1.0REF97_V43675 | 945 | B1.0REF99_V4442 | 37 | 40 | 37 | 12 | | | | | | | | | 33 | 37 | 33 | 8 | | | | | | | | |
| 94 | 916 | B1.0REF97_V43675 | 880 | B1.0REF99_V4472 | 37 | 27 | 24 | 8 | | | | | | | | | | | | | | | | | | | | |
| 95 | 916 | B1.0REF97_V43675 | 69 | B1.0REF99_V4506 | 37 | 31 | 27 | 9 | | | | | | | | | 33 | 31 | 24 | 6 | | | | | | | | |
| 96 | 916 | B1.0REF97_V43675 | 69 | B1.0REF99_V4506 | 37 | 25 | 20 | 7 | | | | | | | | | 33 | 33 | 28 | 7 | | | | | | | | |
| 97 | 916 | B1.0REF97_V43675 | 1012 | B1.0REF99_V4597 | 37 | 39 | 34 | 11 | | | | | | | | | 33 | 34 | 30 | 7 | | | | | | | | |

TABLE 12-continued

| A<br>PAIR | B<br>Endophyte 1 (SEQ ID NO:) | C<br>Endophyte 1 (OTU) | D<br>Endophyte 2 (SEQ ID NO:) | E<br>Endophyte 2 (OTU) | F Bacteria - cultivated | | | | G Bacteria - cultivated, roots | | | | H Bacteria - cultivated, seeds | | | | I Bacteria - wild | | | | J Bacteria - wild, roots | | | | K Bacteria - wild, seeds | | | |
|---|---|---|---|---|---|---|---|---|---|---|---|---|---|---|---|---|---|---|---|---|---|---|---|---|---|---|---|---|
| | | | | | N1 | N2 | OC | EC | N1 | N2 | OC | EC | N1 | N2 | OC | EC | N1 | N2 | OC | EC | N1 | N2 | OC | EC | N1 | N2 | OC | EC |
| 98 | 916 | B1.0REF97_V4\|3675 | 319 | B1.0REF99_V4\|70731 | 37 | 24 | 22 | 7 | | | | | | | | | | | | | | | | | | | | |
| 99 | 916 | B1.0REF97_V4\|3675 | 837 | B1.0REF99_V4\|720 | 37 | 55 | 37 | 16 | | | | | | | | | | | | | | | | | | | | |
| 100 | 916 | B1.0REF97_V4\|3675 | 713 | B1.0REF99_V4\|754 | 37 | 36 | 30 | 11 | | | | | | | | | | | | | | | | | | | | |
| 101 | 916 | B1.0REF97_V4\|3675 | 915 | B1.0REF99_V4\|884 | 37 | 27 | 23 | 8 | | | | | | | | | | | | | | | | | | | | |
| 102 | 916 | B1.0REF97_V4\|3675 | 1007 | B1.0REF99_V4\|9526 | 37 | 42 | 35 | 12 | | | | | | | | | | | | | | | | | | | | |
| 103 | 916 | B1.0REF97_V4\|466 | 1094 | B1.0REF99_V4\|387 | 60 | 43 | 37 | 20 | | | | | | | | | | | | | | | | | | | | |
| 104 | 1106 | B1.0REF97_V4\|466 | 1090 | B1.0REF99_V4\|79117 | | | | | | | | | | | | | 63 | 45 | 42 | 18 | | | | | | | | |
| 105 | 837 | B1.0REF97_V4\|720 | 1007 | B1.0REF99_V4\|9526 | 43 | 31 | 28 | 11 | | | | | | | | | | | | | | | | | | | | |
| 106 | 837 | B1.0REF97_V4\|720 | 137 | B1.0REF99_V4\|411 | 43 | 53 | 38 | 18 | | | | | | | | | 32 | 60 | 28 | 12 | | | | | | | | |
| 107 | 837 | B1.0REF97_V4\|720 | 884 | B1.0REF99_V4\|1164 | 43 | 30 | 28 | 10 | | | | | | | | | | | | | | | | | | | | |
| 108 | 837 | B1.0REF97_V4\|720 | 959 | B1.0REF99_V4\|126 | 43 | 37 | 34 | 13 | | | | | | | | | | | | | | | | | | | | |
| 109 | 837 | B1.0REF97_V4\|720 | 71 | B1.0REF99_V4\|250 | 43 | 38 | 33 | 13 | | | | | | | | | | | | | | | | | | | | |
| 110 | 837 | B1.0REF97_V4\|720 | 116 | B1.0REF99_V4\|1351 | 43 | 35 | 30 | 12 | | | | | | | | | | | | | | | | | | | | |
| 111 | 837 | B1.0REF97_V4\|720 | 1011 | B1.0REF99_V4\|1567 | 43 | 30 | 27 | 10 | | | | | | | | | 32 | 32 | 24 | 6 | | | | | | | | |
| 112 | 837 | B1.0REF97_V4\|720 | 789 | B1.0REF99_V4\|2104 | 43 | 42 | 36 | 14 | | | | | | | | | 32 | 51 | 28 | 10 | | | | | | | | |
| 113 | 837 | B1.0REF97_V4\|720 | 810 | B1.0REF99_V4\|2172 | 43 | 39 | 34 | 13 | | | | | | | | | | | | | | | | | | | | |
| 114 | 837 | B1.0REF97_V4\|720 | 943 | B1.0REF99_V4\|26030 | 43 | 31 | 28 | 11 | | | | | | | | | 32 | 32 | 24 | 6 | | | | | | | | |
| 115 | 837 | B1.0REF97_V4\|720 | 974 | B1.0REF99_V4\|2831 | 43 | 42 | 39 | 14 | | | | | | | | | 32 | 37 | 27 | 7 | | | | | | | | |
| 116 | 837 | B1.0REF97_V4\|720 | 615 | B1.0REF99_V4\|3374 | 43 | 34 | 31 | 12 | | | | | | | | | 32 | 30 | 22 | 6 | | | | | | | | |
| 117 | 837 | B1.0REF97_V4\|720 | 963 | B1.0REF99_V4\|33855 | 43 | 27 | 24 | 9 | | | | | | | | | 32 | 31 | 23 | 6 | | | | | | | | |
| 118 | 837 | B1.0REF97_V4\|720 | 916 | B1.0REF99_V4\|3675 | 43 | 40 | 37 | 14 | | | | | | | | | 32 | 37 | 27 | 7 | | | | | | | | |
| 119 | 837 | B1.0REF97_V4\|720 | 880 | B1.0REF99_V4\|4472 | 43 | 31 | 31 | 11 | | | | | | | | | | | | | | | | | | | | |
| 120 | 837 | B1.0REF97_V4\|720 | 1012 | B1.0REF99_V4\|4597 | 43 | 39 | 36 | 13 | | | | | | | | | 32 | 34 | 25 | 7 | | | | | | | | |
| 121 | 837 | B1.0REF97_V4\|720 | 837 | B1.0REF99_V4\|4720 | 43 | 55 | 43 | 19 | | | | | | | | | 32 | 69 | 32 | 14 | | | | | | | | |
| 122 | 837 | B1.0REF97_V4\|720 | 713 | B1.0REF99_V4\|4754 | 43 | 36 | 31 | 12 | | | | | | | | | | | | | | | | | | | | |
| 123 | 837 | B1.0REF97_V4\|720 | 915 | B1.0REF99_V4\|4884 | 43 | 27 | 24 | 9 | | | | | | | | | | | | | | | | | | | | |
| 124 | 837 | B1.0REF97_V4\|720 | 1007 | B1.0REF99_V4\|49526 | 43 | 42 | 36 | 14 | | | | | | | | | 32 | 41 | 25 | 8 | | | | | 35 | 41 | 35 | 12 |
| 125 | 510 | B1.0REF97_V4\|48981 | 510 | B1.0REF99_V4\|48981 | 24 | 30 | 23 | 6 | | | | 7 | 23 | 26 | 22 | | 36 | 45 | 36 | 10 | | | | | | | | |
| 126 | 1007 | B1.0REF97_V4\|49526 | 137 | B1.0REF99_V4\|411 | 31 | 53 | 31 | 13 | | | | | | | | | | | | | | | | | | | | |
| 127 | 1007 | B1.0REF97_V4\|49526 | 884 | B1.0REF99_V4\|1164 | 31 | 30 | 24 | 7 | | | | | | | | | | | | | | | | | | | | |
| 128 | 1007 | B1.0REF97_V4\|49526 | 959 | B1.0REF99_V4\|126 | 31 | 37 | 25 | 9 | | | | | | | | | | | | | | | | | | | | |
| 129 | 1007 | B1.0REF97_V4\|49526 | 71 | B1.0REF99_V4\|1351 | 31 | 38 | 31 | 9 | | | | | | | | | | | | | | | | | | | | |
| 130 | 1007 | B1.0REF97_V4\|49526 | 1011 | B1.0REF99_V4\|2104 | 31 | 30 | 23 | 7 | | | | | | | | | | | | | | | | | | | | |
| 131 | 1007 | B1.0REF97_V4\|49526 | 789 | B1.0REF99_V4\|2172 | 31 | 42 | 28 | 10 | | | | | | | | | | | | | | | | | | | | |
| 132 | 1007 | B1.0REF97_V4\|49526 | 943 | B1.0REF99_V4\|26030 | 31 | 31 | 25 | 8 | | | | | | | | | 23 | 32 | 21 | 5 | | | | | | | | |
| 133 | 1007 | B1.0REF97_V4\|49526 | 974 | B1.0REF99_V4\|2831 | 31 | 42 | 30 | 10 | | | | | | | | | 23 | 37 | 22 | 5 | | | | | | | | |
| 134 | 1007 | B1.0REF97_V4\|49526 | 615 | B1.0REF99_V4\|3374 | 31 | 34 | 24 | 8 | | | | | | | | | | | | | | | | | | | | |
| 135 | 1007 | B1.0REF97_V4\|49526 | 916 | B1.0REF99_V4\|3675 | 31 | 40 | 30 | 10 | | | | | | | | | 23 | 37 | 22 | 5 | | | | | | | | |
| 136 | 1007 | B1.0REF97_V4\|49526 | 1012 | B1.0REF99_V4\|4597 | 31 | 39 | 27 | 10 | | | | | | | | | 23 | 34 | 22 | 5 | | | | | | | | |
| 137 | 1007 | B1.0REF97_V4\|49526 | 837 | B1.0REF99_V4\|4720 | 31 | 55 | 31 | 13 | | | | | | | | | | | | | | | | | | | | |
| 138 | 1007 | B1.0REF97_V4\|49526 | 1007 | B1.0REF99_V4\|49526 | 31 | 42 | 30 | 13 | | | | | | | | | 61 | 49 | 35 | 19 | | | | | 38 | 45 | 33 | 14 |
| 139 | 372 | B1.0REF97_V4\|10206 | 881 | B1.0REF99_V4\|434 | 41 | 43 | 29 | 14 | | | | 20 | 41 | 42 | 29 | | 38 | 45 | 33 | 11 | | | | | 38 | 30 | 30 | 9 |
| 140 | 1110 | B1.0REF97_V4\|108549 | 1081 | B1.0REF99_V4\|156009 | | | | | | | | | | | | | 38 | 30 | 30 | 7 | | | | | 38 | 30 | 24 | 9 |
| 141 | 1110 | B1.0REF97_V4\|108549 | 1097 | B1.0REF99_V4\|159716 | | | | | | | | | | | | | 38 | 39 | 33 | 9 | | | | | 38 | 33 | 33 | 12 |
| 142 | 1110 | B1.0REF97_V4\|108549 | 1080 | B1.0REF99_V4\|119 | | | | | | | | | | | | | 38 | 47 | 35 | 11 | | | | | 38 | 47 | 35 | 15 |
| 143 | 1110 | B1.0REF97_V4\|108549 | 1086 | B1.0REF99_V4\|25794 | | | | | | | | | | | | | | | | | | | | | | | | |

TABLE 12-continued

| A | B<br>Endophyte | C<br>Endophyte | D<br>Endophyte | E<br>Endophyte | F<br>Bacteria - <br>cultivated | | | G<br>Bacteria - <br>cultivated,<br>roots | | | H<br>Bacteria - <br>cultivated,<br>seeds | | | I<br>Bacteria - <br>wild | | | J<br>Bacteria - <br>wild, roots | | | K<br>Bacteria - <br>wild, seeds | | | |
|---|---|---|---|---|---|---|---|---|---|---|---|---|---|---|---|---|---|---|---|---|---|---|---|
| PAIR | 1 (SEQ ID NO:) | 1 (OTU) | 2 (SEQ ID NO:) | 2 (OTU) | N1 | N2 OC | EC | N1 | N2 OC | EC | N1 | N2 OC | EC | N1 | N2 OC | EC | N1 | N2 OC | EC | N1 | N2 OC | EC |
| 144 | 1110 | B1.0|REF99_V4|108549 | 1093 | B1.0|REF99_V4|29 | | | | | | | | | | 38 | 44 34 | 10 | | | | 38 | 43 34 | 13 |
| 145 | 137 | B1.0|REF99_V4|11 | 884 | B1.0|REF99_V4|1164 | 53 | 30 30 | 13 | | | | | | | | | | | | | | | |
| 146 | 137 | B1.0|REF99_V4|11 | 959 | B1.0|REF99_V4|1126 | 53 | 37 36 | 15 | | | | | | | | | | | | | | | |
| 147 | 137 | B1.0|REF99_V4|11 | 71 | B1.0|REF99_V4|1351 | 53 | 38 35 | 16 | | | | | | | | | | | | | | | |
| 148 | 137 | B1.0|REF99_V4|11 | 116 | B1.0|REF99_V4|1567 | 53 | 35 33 | 15 | | | | | | | | | | | | | | | |
| 149 | 137 | B1.0|REF99_V4|11 | 1180 | B1.0|REF99_V4|166 | 53 | 46 34 | 19 | | | | | | | 60 | 32 32 | 12 | | | | | | |
| 150 | 137 | B1.0|REF99_V4|11 | 656 | B1.0|REF99_V4|191 | 53 | 34 29 | 14 | | | | | | | 60 | 32 29 | 12 | | | | | | |
| 151 | 137 | B1.0|REF99_V4|11 | 1011 | B1.0|REF99_V4|2104 | 53 | 30 29 | 13 | | | | | | | 60 | 51 36 | 19 | | | | | | |
| 152 | 137 | B1.0|REF99_V4|11 | 789 | B1.0|REF99_V4|2172 | 53 | 42 40 | 18 | | | | | | | 60 | 42 35 | 16 | | | | | | |
| 153 | 137 | B1.0|REF99_V4|11 | 810 | B1.0|REF99_V4|250 | 53 | 39 38 | 16 | | | | | | | 60 | 32 32 | 12 | | | | | | |
| 154 | 137 | B1.0|REF99_V4|11 | 943 | B1.0|REF99_V4|26030 | 53 | 31 30 | 13 | | | | | | | 60 | 51 41 | 19 | | | | | | |
| 155 | 137 | B1.0|REF99_V4|11 | 974 | B1.0|REF99_V4|2831 | 53 | 42 41 | 18 | | | | | | | 60 | 32 37 | 12 | | | | | | |
| 156 | 137 | B1.0|REF99_V4|11 | 615 | B1.0|REF99_V4|3374 | 53 | 34 33 | 14 | | | | | | | 60 | 37 37 | 14 | | | | | | |
| 157 | 137 | B1.0|REF99_V4|11 | 963 | B1.0|REF99_V4|33855 | 53 | 26 26 | 11 | | | | | | | 60 | 30 30 | 11 | | | | | | |
| 158 | 137 | B1.0|REF99_V4|11 | 916 | B1.0|REF99_V4|3675 | 53 | 40 39 | 17 | | | | | | | 60 | 31 31 | 12 | | | | | | |
| 159 | 137 | B1.0|REF99_V4|11 | 880 | B1.0|REF99_V4|4754 | 53 | 31 31 | 13 | | | | | | | 60 | 37 29 | 14 | | | | | | |
| 160 | 137 | B1.0|REF99_V4|11 | 69 | B1.0|REF99_V4|472 | 53 | 25 25 | 10 | | | | | | | 60 | 31 29 | 12 | | | | | | |
| 161 | 137 | B1.0|REF99_V4|11 | 1012 | B1.0|REF99_V4|506 | 53 | 39 38 | 16 | | | | | | | 60 | 33 32 | 12 | | | | | | |
| 162 | 137 | B1.0|REF99_V4|11 | 837 | B1.0|REF99_V4|597 | 53 | 43 43 | 23 | | | | | | | 60 | 34 34 | 13 | | | | | | |
| 163 | 137 | B1.0|REF99_V4|11 | 713 | B1.0|REF99_V4|4720 | 53 | 55 43 | 26 | | | | | | | 60 | 69 45 | 26 | | | | | | |
| 164 | 137 | B1.0|REF99_V4|11 | 915 | B1.0|REF99_V4|4754 | 53 | 36 33 | 15 | | | | | | | 60 | 37 33 | 14 | | | | | | |
| 165 | 137 | B1.0|REF99_V4|11 | 1007 | B1.0|REF99_V4|4884 | 53 | 27 26 | 11 | | | | | | | 60 | 28 28 | 11 | | | | | | |
| 166 | 137 | B1.0|REF99_V4|11 | 959 | B1.0|REF99_V4|49526 | 53 | 42 39 | 18 | | | | | | | 60 | 41 36 | 15 | | | | | | |
| 167 | 884 | B1.0|REF99_V4|1164 | 71 | B1.0|REF99_V4|1351 | 30 | 37 27 | 9 | | | | | | | 24 | 32 22 | 5 | | | | | | |
| 168 | 884 | B1.0|REF99_V4|1164 | 1011 | B1.0|REF99_V4|2104 | 30 | 38 25 | 9 | | | | | | | | | | | | | | | |
| 169 | 884 | B1.0|REF99_V4|1164 | 789 | B1.0|REF99_V4|2172 | 30 | 30 25 | 7 | | | | | | | | | | | | | | | |
| 170 | 884 | B1.0|REF99_V4|1164 | 810 | B1.0|REF99_V4|250 | 30 | 42 28 | 10 | | | | | | | | | | | | | | | |
| 171 | 884 | B1.0|REF99_V4|1164 | 943 | B1.0|REF99_V4|26030 | 30 | 39 28 | 9 | | | | | | | 24 | 32 21 | 5 | | | | | | |
| 172 | 884 | B1.0|REF99_V4|1164 | 974 | B1.0|REF99_V4|2831 | 30 | 31 24 | 7 | | | | | | | 24 | 32 24 | 6 | | | | | | |
| 173 | 884 | B1.0|REF99_V4|1164 | 615 | B1.0|REF99_V4|3374 | 30 | 42 30 | 10 | | | | | | | | | | | | | | | |
| 174 | 884 | B1.0|REF99_V4|1164 | 916 | B1.0|REF99_V4|3675 | 30 | 34 26 | 8 | | | | | | | 24 | 37 24 | 6 | | | | | | |
| 175 | 884 | B1.0|REF99_V4|1164 | 1012 | B1.0|REF99_V4|597 | 30 | 40 29 | 9 | | | | | | | 24 | 34 22 | 5 | | | | | | |
| 176 | 884 | B1.0|REF99_V4|1164 | 837 | B1.0|REF99_V4|4720 | 30 | 39 29 | 9 | | | | | | | | | | | | | | | |
| 177 | 884 | B1.0|REF99_V4|1164 | 1007 | B1.0|REF99_V4|49526 | 30 | 55 30 | 13 | | | | | | | | | | | | | | | |
| 178 | 884 | B1.0|REF99_V4|1211 | 1158 | B1.0|REF99_V4|1323 | 30 | 42 28 | 10 | | | | | | | 70 | 82 52 | 36 | | | | 52 | 66 41 | 28 |
| 179 | 121 | B1.0|REF99_V4|1126 | 71 | B1.0|REF99_V4|1351 | 37 | 38 32 | 11 | | | | | | | | | | | | | | | |
| 180 | 959 | B1.0|REF99_V4|1126 | 648 | B1.0|REF99_V4|14 | 37 | 78 37 | 23 | | | | | | | | | | | | | | | |
| 181 | 959 | B1.0|REF99_V4|1126 | 116 | B1.0|REF99_V4|1567 | 37 | 35 30 | 10 | | | | | | | | | | | | | | | |
| 183 | 959 | B1.0|REF99_V4|1126 | 656 | B1.0|REF99_V4|191 | 37 | 34 25 | 10 | | | | | | | | | | | | | | | |
| 184 | 959 | B1.0|REF99_V4|1126 | 1011 | B1.0|REF99_V4|2104 | 37 | 28 28 | 9 | | | | | | | | | | | | | | | |
| 185 | 959 | B1.0|REF99_V4|1126 | 789 | B1.0|REF99_V4|2172 | 37 | 42 35 | 12 | | | | | | | | | | | | | | | |
| 186 | 959 | B1.0|REF99_V4|1126 | 810 | B1.0|REF99_V4|250 | 37 | 39 34 | 11 | | | | | | | | | | | | | | | |
| 187 | 959 | B1.0|REF99_V4|1126 | 131 | B1.0|REF99_V4|251 | 37 | 33 25 | 10 | | | | | | | | | | | | | | | |
| 188 | 959 | B1.0|REF99_V4|1126 | 943 | B1.0|REF99_V4|26030 | 37 | 31 28 | 9 | | | | | | | | | | | | | | | |
| 189 | 959 | B1.0|REF99_V4|1126 | 974 | B1.0|REF99_V4|2831 | 37 | 42 37 | 12 | | | | | | | | | | | | | | | |
| 190 | 959 | B1.0|REF99_V4|1126 | 615 | B1.0|REF99_V4|3374 | 37 | 34 30 | 10 | | | | | | | | | | | | | | | |

TABLE 12-continued

| A | B | C | D | E | F Bacteria - cultivated | | | | G Bacteria - cultivated, roots | | | | H Bacteria - cultivated, seeds | | | | I Bacteria - wild | | | | J Bacteria - wild, roots | | | | K Bacteria - wild, seeds | | | |
|---|---|---|---|---|---|---|---|---|---|---|---|---|---|---|---|---|---|---|---|---|---|---|---|---|---|---|---|---|---|
| PAIR | Endophyte 1 (SEQ ID NO:) | Endophyte 1 (OTU) | Endophyte 2 (SEQ ID NO:) | Endophyte 2 (OTU) | N1 | N2 | OC | EC | N1 | N2 | OC | EC | N1 | N2 | OC | EC | N1 | N2 | OC | EC | N1 | N2 | OC | EC | N1 | N2 | OC | EC |
| 191 | 959 | B1.0|REF99_V4|126 | 963 | B1.0|REF99_V4|33855 | 37 | 27 | 23 | 8 | | | | | | | | | | | | | | | | | | | | |
| 192 | 959 | B1.0|REF99_V4|126 | 961 | B1.0|REF99_V4|3580 | 37 | 21 | 21 | 6 | | | | | | | | | | | | | | | | | | | | |
| 193 | 959 | B1.0|REF99_V4|126 | 916 | B1.0|REF99_V4|3675 | 37 | 40 | 35 | 12 | | | | | | | | | | | | | | | | | | | | |
| 194 | 959 | B1.0|REF99_V4|126 | 945 | B1.0|REF99_V4|442 | 37 | 27 | 24 | 8 | | | | | | | | | | | | | | | | | | | | |
| 195 | 959 | B1.0|REF99_V4|126 | 880 | B1.0|REF99_V4|472 | 37 | 31 | 27 | 9 | | | | | | | | | | | | | | | | | | | | |
| 196 | 959 | B1.0|REF99_V4|126 | 69 | B1.0|REF99_V4|506 | 37 | 25 | 21 | 7 | | | | | | | | | | | | | | | | | | | | |
| 197 | 959 | B1.0|REF99_V4|126 | 1012 | B1.0|REF99_V4|597 | 37 | 39 | 35 | 11 | | | | | | | | | | | | | | | | | | | | |
| 198 | 959 | B1.0|REF99_V4|126 | 837 | B1.0|REF99_V4|720 | 37 | 55 | 37 | 16 | | | | | | | | | | | | | | | | | | | | |
| 199 | 959 | B1.0|REF99_V4|126 | 713 | B1.0|REF99_V4|754 | 37 | 36 | 31 | 11 | | | | | | | | | | | | | | | | | | | | |
| 200 | 959 | B1.0|REF99_V4|126 | 915 | B1.0|REF99_V4|884 | 37 | 27 | 26 | 8 | | | | | | | | | | | | | | | | | | | | |
| 201 | 959 | B1.0|REF99_V4|126 | 1007 | B1.0|REF99_V4|9526 | 37 | 42 | 34 | 12 | | | | | | | | | | | | | | | | | | | | |
| 202 | 886 | B1.0|REF99_V4|1287 | 974 | B1.0|REF99_V4|2831 | 24 | 42 | 24 | 8 | | | | | | | | | | | | | | | | | | | | |
| 203 | 886 | B1.0|REF99_V4|1287 | 916 | B1.0|REF99_V4|3675 | 24 | 40 | 23 | 8 | | | | | | | | | | | | | | | | | | | | |
| 204 | 939 | B1.0|REF99_V4|1317 | 1012 | B1.0|REF99_V4|597 | 32 | 39 | 25 | 10 | | | | | | | | | | | | | | | | | | | | |
| 205 | 71 | B1.0|REF99_V4|1351 | 116 | B1.0|REF99_V4|1567 | 38 | 35 | 29 | 11 | | | | | 32 | 32 | 24 | 6 | | | | | | | | | | | | |
| 206 | 71 | B1.0|REF99_V4|1351 | 1011 | B1.0|REF99_V4|2104 | 38 | 30 | 26 | 9 | | | | | 32 | 32 | 28 | 6 | | | | | | | | | | | | |
| 207 | 71 | B1.0|REF99_V4|1351 | 789 | B1.0|REF99_V4|2172 | 38 | 42 | 34 | 13 | | | | | 32 | 51 | 30 | 10 | | | | | | | | | | | | |
| 208 | 71 | B1.0|REF99_V4|1351 | 810 | B1.0|REF99_V4|250 | 38 | 39 | 33 | 12 | | | | | | | | | | | | | | | | | | | | |
| 209 | 71 | B1.0|REF99_V4|1351 | 131 | B1.0|REF99_V4|251 | 38 | 33 | 25 | 10 | | | | | 32 | 30 | 23 | 6 | | | | | | | | | | | | |
| 210 | 71 | B1.0|REF99_V4|1351 | 943 | B1.0|REF99_V4|26030 | 38 | 31 | 27 | 9 | | | | | 32 | 32 | 28 | 6 | | | | | | | | | | | | |
| 211 | 71 | B1.0|REF99_V4|1351 | 974 | B1.0|REF99_V4|2831 | 38 | 42 | 36 | 13 | | | | | 32 | 37 | 32 | 7 | | | | | | | | | | | | |
| 212 | 71 | B1.0|REF99_V4|1351 | 615 | B1.0|REF99_V4|3374 | 38 | 34 | 30 | 10 | | | | | 32 | 30 | 26 | 6 | | | | | | | | | | | | |
| 213 | 71 | B1.0|REF99_V4|1351 | 963 | B1.0|REF99_V4|33855 | 38 | 27 | 23 | 8 | | | | | 32 | 31 | 24 | 6 | | | | | | | | | | | | |
| 214 | 71 | B1.0|REF99_V4|1351 | 916 | B1.0|REF99_V4|3675 | 38 | 40 | 34 | 12 | | | | | 32 | 37 | 32 | 7 | | | | | | | | | | | | |
| 215 | 71 | B1.0|REF99_V4|1351 | 880 | B1.0|REF99_V4|472 | 38 | 31 | 28 | 9 | | | | | 32 | 31 | 23 | 6 | | | | | | | | | | | | |
| 216 | 71 | B1.0|REF99_V4|1351 | 69 | B1.0|REF99_V4|506 | 38 | 25 | 22 | 8 | | | | | 32 | 33 | 27 | 7 | | | | | | | | | | | | |
| 217 | 71 | B1.0|REF99_V4|1351 | 1012 | B1.0|REF99_V4|597 | 38 | 39 | 33 | 12 | | | | | 32 | 34 | 29 | 7 | | | | | | | | | | | | |
| 218 | 71 | B1.0|REF99_V4|1351 | 837 | B1.0|REF99_V4|720 | 38 | 55 | 36 | 17 | | | | | 32 | 69 | 32 | 14 | | | | | | | | | | | | |
| 219 | 71 | B1.0|REF99_V4|1351 | 713 | B1.0|REF99_V4|754 | 38 | 36 | 30 | 11 | | | | | 32 | 37 | 27 | 7 | | | | | | | | | | | | |
| 220 | 71 | B1.0|REF99_V4|1351 | 915 | B1.0|REF99_V4|884 | 38 | 27 | 25 | 8 | | | | | 32 | 28 | 25 | 6 | | | | | | | | | | | | |
| 221 | 71 | B1.0|REF99_V4|1351 | 1007 | B1.0|REF99_V4|9526 | 38 | 42 | 33 | 13 | | | | | 32 | 41 | 29 | 8 | | | | | | | | | | | | |
| 222 | 648 | B1.0|REF99_V4|14 | 1180 | B1.0|REF99_V4|1166 | 78 | 42 | 26 | | | | | | 83 | 51 | 46 | 27 | | | | | | | | | | | | |
| 223 | 648 | B1.0|REF99_V4|14 | 974 | B1.0|REF99_V4|2831 | 78 | 42 | 25 | | | | | | 83 | 37 | 37 | 19 | | | | | | | | | | | | |
| 224 | 648 | B1.0|REF99_V4|14 | 916 | B1.0|REF99_V4|3675 | 78 | 40 | 24 | | | | | | 83 | 37 | 37 | 19 | | | | | | | | | | | | |
| 225 | 648 | B1.0|REF99_V4|14 | 1012 | B1.0|REF99_V4|597 | 78 | 39 | 23 | | | | | | 83 | 34 | 34 | 18 | | | | | | | | | | | | |
| 226 | 648 | B1.0|REF99_V4|14 | 713 | B1.0|REF99_V4|754 | 78 | 36 | 35 | | | | | | 83 | 37 | 36 | 19 | | | | | | | | | | | | |
| 227 | 648 | B1.0|REF99_V4|14 | 1007 | B1.0|REF99_V4|9526 | 78 | 42 | 39 | 22 | | | | | 83 | 41 | 39 | 21 | | | | | | | | | | | | |
| 228 | 1112 | B1.0|REF99_V4|14460 | 1088 | B1.0|REF99_V4|1703 | 40 | 44 | 29 | 14 | | | 40 | 38 | 36 | 40 | 85 | 75 | 58 | 40 | | | | | | | | | | | |
| 229 | 1112 | B1.0|REF99_V4|14460 | 1109 | B1.0|REF99_V4|25629 | 40 | 38 | 36 | 12 | | | 40 | 27 | 26 | 13 | 85 | 81 | 71 | 43 | | | | | 85 | 81 | 71 | 56 | | |
| 230 | 1112 | B1.0|REF99_V4|14460 | 1094 | B1.0|REF99_V4|387 | | | | | | | | | | | | | 85 | 64 | 54 | 34 | | | | | | | | | | |
| 231 | 1112 | B1.0|REF99_V4|14460 | 1095 | B1.0|REF99_V4|54497 | 30 | 27 | 21 | 6 | | | 26 | 22 | 18 | 7 | 50 | 39 | 30 | 12 | | | | | 46 | 38 | 30 | 14 | | |
| 232 | 1091 | B1.0|REF99_V4|15 | 1080 | B1.0|REF99_V4|19 | | | | | | | 26 | 23 | 17 | 7 | 50 | 65 | 41 | 20 | | | | | 46 | 64 | 41 | 24 | | |
| 233 | 1091 | B1.0|REF99_V4|15 | 1077 | B1.0|REF99_V4|209 | 30 | 26 | 19 | 6 | | | 26 | 26 | 19 | 8 | 50 | 47 | 32 | 15 | | | | | 46 | 47 | 32 | 18 | | |
| 234 | 1091 | B1.0|REF99_V4|15 | 1086 | B1.0|REF99_V4|25794 | | | | | | | | | | | 50 | 44 | 35 | 14 | | | | | 46 | 43 | 35 | 16 | | |
| 235 | 1091 | B1.0|REF99_V4|15 | 1093 | B1.0|REF99_V4|29 | | | | | | | 31 | 32 | 24 | 12 | 53 | 63 | 42 | 21 | | | | | 53 | 63 | 42 | 27 | | |
| 236 | 1191 | B1.0|REF99_V4|150716 | 972 | B1.0|REF99_V4|218 | 32 | 32 | 24 | 8 | | | | | | | | | | | | | | | | | | | | | | |

TABLE 12-continued

| PAIR | B Endophyte 1 (SEQ ID NO:) | C Endophyte 1 (OTU) | D Endophyte 2 (SEQ ID NO:) | E Endophyte 2 (OTU) | F Bacteria - cultivated | | | | G Bacteria - cultivated, roots | | | | H Bacteria - cultivated, seeds | | | | I Bacteria - wild | | | | J Bacteria - wild, roots | | | | K Bacteria - wild, seeds | | | |
|---|---|---|---|---|---|---|---|---|---|---|---|---|---|---|---|---|---|---|---|---|---|---|---|---|---|---|---|---|
| | | | | | N1 | N2 | OC | EC | N1 | N2 | OC | EC | N1 | N2 | OC | EC | N1 | N2 | OC | EC | N1 | N2 | OC | EC | N1 | N2 | OC | EC |
| 237 | 1191 | B1.0|REF99_V4|50716 | 1163 | B1.0|REF99_V4|46806 | 32 | 28 | 20 | 7 | | | | | 31 | 28 | 20 | 10 | 53 | 55 | 35 | 18 | | | | | 53 | 46 | 37 | 20 |
| 238 | 1191 | B1.0|REF99_V4|50716 | 957 | B1.0|REF99_V4|4921 | 32 | 45 | 24 | 11 | | | | | 31 | 32 | 23 | 16 | 53 | 48 | 37 | 16 | | | | | 45 | 64 | 39 | 23 |
| 239 | 1081 | B1.0|REF99_V4|56009 | 1077 | B1.0|REF99_V4|4209 | | | | | | | | | | | | | 45 | 65 | 37 | 18 | | | | | 45 | 47 | 37 | 17 |
| 240 | 1081 | B1.0|REF99_V4|56009 | 1086 | B1.0|REF99_V4|25794 | | | | | | | | | | | | | 45 | 44 | 34 | 13 | | | | | 45 | 43 | 34 | 16 |
| 241 | 1081 | B1.0|REF99_V4|56009 | 1093 | B1.0|REF99_V4|29 | | | | | | | | | | | | | 45 | 37 | 25 | 12 | | | | | | | | |
| 242 | 739 | B1.0|REF99_V4|1562 | 974 | B1.0|REF99_V4|2831 | | | | | | | | | | | | | 25 | 37 | 25 | 6 | | | | | | | | |
| 243 | 739 | B1.0|REF99_V4|1562 | 916 | B1.0|REF99_V4|43675 | | | | | | | | | | | | | 25 | 37 | 25 | 6 | | | | | | | | |
| 244 | 739 | B1.0|REF99_V4|1562 | 1012 | B1.0|REF99_V4|4597 | | | | | | | | | | | | | 25 | 34 | 25 | 5 | | | | | | | | |
| 245 | 116 | B1.0|REF99_V4|1567 | 1011 | B1.0|REF99_V4|42104 | 35 | 30 | 24 | 8 | | | | | | | | | 32 | 32 | 23 | 6 | | | | | | | | |
| 246 | 116 | B1.0|REF99_V4|1567 | 789 | B1.0|REF99_V4|42172 | 35 | 42 | 33 | 12 | | | | | | | | | 32 | 51 | 28 | 10 | | | | | | | | |
| 247 | 116 | B1.0|REF99_V4|1567 | 810 | B1.0|REF99_V4|4250 | 35 | 39 | 31 | 11 | | | | | | | | | | | | | | | | | | | | |
| 248 | 116 | B1.0|REF99_V4|1567 | 943 | B1.0|REF99_V4|26030 | 35 | 31 | 26 | 9 | | | | | | | | | 32 | 32 | 25 | 6 | | | | | | | | |
| 249 | 116 | B1.0|REF99_V4|1567 | 974 | B1.0|REF99_V4|2831 | 35 | 42 | 33 | 12 | | | | | | | | | 32 | 37 | 28 | 7 | | | | | | | | |
| 250 | 116 | B1.0|REF99_V4|1567 | 615 | B1.0|REF99_V4|3374 | 35 | 34 | 26 | 9 | | | | | | | | | | | | | | | | | | | | |
| 251 | 116 | B1.0|REF99_V4|1567 | 916 | B1.0|REF99_V4|43675 | 35 | 40 | 32 | 11 | | | | | | | | | 32 | 37 | 28 | 7 | | | | | | | | |
| 252 | 116 | B1.0|REF99_V4|1567 | 880 | B1.0|REF99_V4|472 | 35 | 31 | 23 | 9 | | | | | | | | | 32 | 31 | 23 | 6 | | | | | | | | |
| 253 | 116 | B1.0|REF99_V4|1567 | 69 | B1.0|REF99_V4|506 | 35 | 25 | 20 | 7 | | | | | | | | | 32 | 33 | 24 | 7 | | | | | | | | |
| 254 | 116 | B1.0|REF99_V4|1567 | 1012 | B1.0|REF99_V4|4597 | 35 | 39 | 30 | 11 | | | | | | | | | 32 | 34 | 25 | 7 | | | | | | | | |
| 255 | 116 | B1.0|REF99_V4|1567 | 837 | B1.0|REF99_V4|4720 | 35 | 34 | 29 | 15 | | | | | | | | | 32 | 37 | 25 | 7 | | | | | | | | |
| 256 | 116 | B1.0|REF99_V4|1567 | 713 | B1.0|REF99_V4|4754 | 35 | 36 | 29 | 10 | | | | | | | | | 32 | 28 | 22 | 6 | | | | | | | | |
| 257 | 116 | B1.0|REF99_V4|1567 | 915 | B1.0|REF99_V4|4884 | 35 | 27 | 21 | 7 | | | | | | | | | 32 | 41 | 26 | 8 | | | | | | | | |
| 258 | 116 | B1.0|REF99_V4|1567 | 1007 | B1.0|REF99_V4|49526 | 35 | 42 | 32 | 12 | | | | | | | | | 30 | 47 | 30 | 9 | | | | | 30 | 47 | 30 | 12 |
| 259 | 1097 | B1.0|REF99_V4|59716 | 1086 | B1.0|REF99_V4|25794 | | | | | | | | 15.5 | 14 | 26 | 13 | 4 | | | | | | | | | | | | |
| 260 | 1171 | B1.0|REF99_V4|1639 | 943 | B1.0|REF99_V4|26030 | 21 | 31 | 20 | 5 | 21 | 31 | 20 | 15.5 | | | | | 22 | 37 | 22 | 5 | | | | | | | | |
| 261 | 1171 | B1.0|REF99_V4|1639 | 974 | B1.0|REF99_V4|2831 | 21 | 42 | 21 | 7 | | | | | | | | | 22 | 37 | 23 | 5 | | | | | | | | |
| 262 | 1180 | B1.0|REF99_V4|166 | 916 | B1.0|REF99_V4|43675 | 21 | 40 | 29 | 15 | | | | | | | | | 51 | 37 | 30 | 12 | | | | | | | | |
| 263 | 1180 | B1.0|REF99_V4|166 | 974 | B1.0|REF99_V4|2831 | 46 | 42 | 28 | 15 | | | | | | | | | 51 | 37 | 30 | 12 | | | | | | | | |
| 264 | 1180 | B1.0|REF99_V4|166 | 916 | B1.0|REF99_V4|43675 | 46 | 39 | 27 | 14 | | | | | | | | | 51 | 34 | 29 | 11 | | | | | | | | |
| 265 | 1180 | B1.0|REF99_V4|166 | 1012 | B1.0|REF99_V4|4597 | 46 | 24 | 21 | 8 | | | | | | | | | 75 | 65 | 56 | 31 | | | | | 75 | 64 | 56 | 39 |
| 266 | 1088 | B1.0|REF99_V4|1703 | 1077 | B1.0|REF99_V4|4209 | 44 | 38 | 30 | 13 | | | | | 44 | 23 | 21 | 12 | 75 | 81 | 63 | 38 | | | | | 75 | 81 | 63 | 49 |
| 267 | 1088 | B1.0|REF99_V4|1703 | 1109 | B1.0|REF99_V4|25629 | | | | | | | | | 44 | 38 | 30 | 20 | 75 | 64 | 50 | 30 | | | | | | | | |
| 268 | 1088 | B1.0|REF99_V4|1703 | 1095 | B1.0|REF99_V4|54497 | | | | | | | | | | | | | 31 | 51 | 26 | 10 | | | | | | | | |
| 269 | 889 | B1.0|REF99_V4|4185 | 789 | B1.0|REF99_V4|42172 | 31 | 42 | 25 | 10 | | | | | | | | | 31 | 51 | 26 | 7 | | | | | | | | |
| 270 | 889 | B1.0|REF99_V4|4185 | 974 | B1.0|REF99_V4|2831 | 31 | 42 | 27 | 11 | | | | | | | | | 31 | 37 | 25 | 7 | | | | | | | | |
| 271 | 889 | B1.0|REF99_V4|4185 | 916 | B1.0|REF99_V4|43675 | 31 | 40 | 24 | 10 | | | | | | | | | 31 | 37 | 25 | 7 | | | | | | | | |
| 272 | 889 | B1.0|REF99_V4|4185 | 1012 | B1.0|REF99_V4|4597 | 31 | 39 | 24 | 10 | | | | | 22 | 26 | 16 | 7 | | | | | | | | | | | | |
| 273 | 1080 | B1.0|REF99_V4|419 | 1086 | B1.0|REF99_V4|25794 | | | | | | | | | | | | | 39 | 47 | 34 | 12 | | | | | 38 | 47 | 34 | 15 |
| 274 | 1080 | B1.0|REF99_V4|419 | 1093 | B1.0|REF99_V4|29 | | | | | | | | | | | | | 39 | 44 | 31 | 11 | | | | | 38 | 43 | 33 | 13 |
| 275 | 656 | B1.0|REF99_V4|4191 | 789 | B1.0|REF99_V4|42172 | 34 | 42 | 27 | 11 | | | | | | | | | 42 | 51 | 30 | 13 | | | | | | | | |
| 276 | 656 | B1.0|REF99_V4|4191 | 974 | B1.0|REF99_V4|2831 | 34 | 42 | 27 | 11 | | | | | | | | | 42 | 37 | 30 | 10 | | | | | | | | |
| 277 | 656 | B1.0|REF99_V4|4191 | 916 | B1.0|REF99_V4|43675 | 34 | 40 | 25 | 11 | | | | | | | | | 42 | 37 | 30 | 10 | | | | | | | | |
| 278 | 656 | B1.0|REF99_V4|4191 | 1012 | B1.0|REF99_V4|4597 | 31 | 39 | 25 | 10 | | | | | | | | | 42 | 34 | 28 | 9 | | | | | | | | |
| 279 | 656 | B1.0|REF99_V4|4191 | 837 | B1.0|REF99_V4|4720 | 34 | 55 | 29 | 15 | 27 | 34 | 27 | 21.9 | | | | | | | | | | | | | | | | |
| 280 | 656 | B1.0|REF99_V4|4191 | 713 | B1.0|REF99_V4|4754 | 34 | 36 | 27 | 10 | | | | | | | | | 42 | 37 | 29 | 10 | | | | | | | | |
| 281 | 656 | B1.0|REF99_V4|4191 | 915 | B1.0|REF99_V4|4884 | 34 | 27 | 21 | 7 | | | | | | | | | 42 | 28 | 25 | 7 | | | | | | | | |
| 282 | 656 | B1.0|REF99_V4|4191 | 1007 | B1.0|REF99_V4|49526 | 34 | 42 | 25 | 11 | | | | | | | | | 42 | 41 | 29 | 11 | | | | | | | | |

TABLE 12-continued

| A | B | C | D | E | F Bacteria - cultivated | | | | G Bacteria - cultivated, roots | | | | H Bacteria - cultivated, seeds | | | | I Bacteria - wild | | | | J Bacteria - wild, roots | | | | K Bacteria - wild, seeds | | | |
|---|---|---|---|---|---|---|---|---|---|---|---|---|---|---|---|---|---|---|---|---|---|---|---|---|---|---|---|---|---|
| PAIR | Endophyte 1 (SEQ ID NO:) | Endophyte 1 (OTU) | Endophyte 2 (SEQ ID NO:) | Endophyte 2 (OTU) | N1 | N2 | OC | EC | N1 | N2 | OC | EC | N1 | N2 | OC | EC | N1 | N2 | OC | EC | N1 | N2 | OC | EC | N1 | N2 | OC | EC |
| 283 | 1195 | B1.0\_REF99\_V4\_1916 | 881 | B1.0\_REF99\_V4\_4434 | 27 | 43 | 22 | 9 | | | | | 27 | 42 | 22 | 13 | 33 | 49 | 28 | 10 | | | | | 33 | 48 | 28 | 13 |
| 284 | 1077 | B1.0\_REF99\_V4\_209 | 1109 | B1.0\_REF99\_V4\_25629 | | | | | | | | | | | | | 65 | 81 | 54 | 33 | | | | | | | | |
| 285 | 1077 | B1.0\_REF99\_V4\_209 | 1086 | B1.0\_REF99\_V4\_25794 | | | | | | | | | | | | | 65 | 47 | 39 | 19 | | | | | 64 | 47 | 39 | 25 |
| 286 | 1011 | B1.0\_REF99\_V4\_2104 | 789 | B1.0\_REF99\_V4\_2172 | 30 | 42 | 29 | 10 | | | | | | | | | 32 | 51 | 31 | 10 | | | | | | | | |
| 287 | 1011 | B1.0\_REF99\_V4\_2104 | 810 | B1.0\_REF99\_V4\_250 | 30 | 39 | 27 | 9 | | | | | | | | | | | | | | | | | | | | |
| 288 | 1011 | B1.0\_REF99\_V4\_2104 | 131 | B1.0\_REF99\_V4\_251 | 30 | 33 | 23 | 8 | | | | | | | | | | | | | | | | | | | | |
| 289 | 1011 | B1.0\_REF99\_V4\_2104 | 943 | B1.0\_REF99\_V4\_26030 | 30 | 31 | 26 | 7 | | | | | | | | | 32 | 32 | 28 | 6 | | | | | | | | |
| 290 | 1011 | B1.0\_REF99\_V4\_2104 | 974 | B1.0\_REF99\_V4\_2831 | 30 | 42 | 30 | 10 | | | | | | | | | 32 | 37 | 32 | 7 | | | | | | | | |
| 291 | 1011 | B1.0\_REF99\_V4\_2104 | 615 | B1.0\_REF99\_V4\_3374 | 30 | 34 | 27 | 8 | | | | | | | | | 32 | 30 | 27 | 6 | | | | | | | | |
| 292 | 1011 | B1.0\_REF99\_V4\_2104 | 963 | B1.0\_REF99\_V4\_33855 | 30 | 27 | 23 | 6 | | | | | | | | | 32 | 31 | 24 | 6 | | | | | | | | |
| 293 | 1011 | B1.0\_REF99\_V4\_2104 | 916 | B1.0\_REF99\_V4\_43675 | 30 | 40 | 30 | 9 | | | | | | | | | 32 | 37 | 32 | 7 | | | | | | | | |
| 294 | 1011 | B1.0\_REF99\_V4\_2104 | 880 | B1.0\_REF99\_V4\_4472 | 30 | 31 | 24 | 7 | | | | | | | | | | | | | | | | | | | | |
| 295 | 1011 | B1.0\_REF99\_V4\_2104 | 69 | B1.0\_REF99\_V4\_506 | | | | | | | | | | | | | | | | | | | | | | | | |
| 296 | 1011 | B1.0\_REF99\_V4\_2104 | 1012 | B1.0\_REF99\_V4\_597 | 30 | 39 | 27 | 9 | | | | | | | | | 32 | 33 | 27 | 7 | | | | | | | | |
| 297 | 1011 | B1.0\_REF99\_V4\_2104 | 837 | B1.0\_REF99\_V4\_720 | 30 | 55 | 30 | 13 | | | | | | | | | 32 | 34 | 29 | 7 | | | | | | | | |
| 298 | 1011 | B1.0\_REF99\_V4\_2104 | 713 | B1.0\_REF99\_V4\_754 | 30 | 36 | 26 | 9 | | | | | | | | | 32 | 69 | 32 | 14 | | | | | | | | |
| 299 | 1011 | B1.0\_REF99\_V4\_2104 | 915 | B1.0\_REF99\_V4\_884 | 30 | 27 | 20 | 6 | | | | | | | | | 32 | 37 | 23 | 6 | | | | | | | | |
| 300 | 1011 | B1.0\_REF99\_V4\_2104 | 1007 | B1.0\_REF99\_V4\_9526 | 30 | 42 | 28 | 10 | | | | | | | | | 32 | 41 | 29 | 8 | | | | | | | | |
| 301 | 789 | B1.0\_REF99\_V4\_2172 | 810 | B1.0\_REF99\_V4\_250 | 42 | 39 | 36 | 13 | | | | | | | | | | | | | | | | | | | | |
| 302 | 789 | B1.0\_REF99\_V4\_2172 | 131 | B1.0\_REF99\_V4\_251 | 42 | 33 | 28 | 11 | | | | | | | | | | | | | | | | | | | | |
| 303 | 789 | B1.0\_REF99\_V4\_2172 | 943 | B1.0\_REF99\_V4\_26030 | 42 | 31 | 31 | 10 | | | | | | | | | 51 | 32 | 30 | 10 | | | | | | | | |
| 304 | 789 | B1.0\_REF99\_V4\_2172 | 974 | B1.0\_REF99\_V4\_2831 | 42 | 42 | 39 | 14 | | | | | | | | | 51 | 37 | 35 | 12 | | | | | | | | |
| 305 | 789 | B1.0\_REF99\_V4\_2172 | 615 | B1.0\_REF99\_V4\_3374 | 42 | 34 | 32 | 11 | | | | | | | | | 51 | 30 | 28 | 10 | | | | | | | | |
| 306 | 789 | B1.0\_REF99\_V4\_2172 | 963 | B1.0\_REF99\_V4\_33855 | 42 | 27 | 25 | 9 | | | | | | | | | 51 | 31 | 27 | 10 | | | | | | | | |
| 307 | 789 | B1.0\_REF99\_V4\_2172 | 916 | B1.0\_REF99\_V4\_43675 | 42 | 40 | 37 | 13 | | | | | | | | | 51 | 37 | 35 | 12 | | | | | | | | |
| 308 | 789 | B1.0\_REF99\_V4\_2172 | 880 | B1.0\_REF99\_V4\_4472 | 42 | 31 | 30 | 10 | | | | | | | | | | | | | | | | | | | | |
| 309 | 789 | B1.0\_REF99\_V4\_2172 | 69 | B1.0\_REF99\_V4\_506 | 42 | 25 | 23 | 8 | | | | | | | | | 51 | 33 | 31 | 11 | | | | | | | | |
| 310 | 789 | B1.0\_REF99\_V4\_2172 | 1012 | B1.0\_REF99\_V4\_597 | 42 | 39 | 36 | 13 | | | | | | | | | 51 | 34 | 32 | 11 | | | | | | | | |
| 311 | 789 | B1.0\_REF99\_V4\_2172 | 837 | B1.0\_REF99\_V4\_720 | 42 | 55 | 40 | 18 | | | | | | | | | 51 | 69 | 41 | 22 | | | | | | | | |
| 312 | 789 | B1.0\_REF99\_V4\_2172 | 713 | B1.0\_REF99\_V4\_754 | 42 | 36 | 34 | 12 | | | | | | | | | 51 | 37 | 30 | 12 | | | | | | | | |
| 313 | 789 | B1.0\_REF99\_V4\_2172 | 915 | B1.0\_REF99\_V4\_884 | 42 | 27 | 25 | 9 | | | | | | | | | 51 | 28 | 27 | 9 | | | | | | | | |
| 314 | 789 | B1.0\_REF99\_V4\_2172 | 1007 | B1.0\_REF99\_V4\_9526 | 42 | 42 | 36 | 14 | | | | | | | | | 51 | 41 | 34 | 13 | | | | | | | | |
| 315 | 972 | B1.0\_REF99\_V4\_218 | 957 | B1.0\_REF99\_V4\_921 | | | | | | | | | 32 | 32 | 23 | 12 | 63 | 48 | 39 | 19 | | | | | 63 | 46 | 39 | 24 |
| 316 | 681 | B1.0\_REF99\_V4\_2234 | 837 | B1.0\_REF99\_V4\_720 | 46 | 55 | 39 | 20 | | | | | | | | | | | | | | | | | | | | |
| 317 | 683 | B1.0\_REF99\_V4\_2385 | 974 | B1.0\_REF99\_V4\_2831 | 22 | 42 | 22 | 7 | | | | | | | | | | | | | | | | | | | | |
| 318 | 683 | B1.0\_REF99\_V4\_2385 | 1012 | B1.0\_REF99\_V4\_597 | 22 | 39 | 22 | 7 | | | | | | | | | | | | | | | | | | | | |
| 319 | 810 | B1.0\_REF99\_V4\_250 | 943 | B1.0\_REF99\_V4\_26030 | 39 | 31 | 28 | 10 | | | | | | | | | | | | | | | | | | | | |
| 320 | 810 | B1.0\_REF99\_V4\_250 | 974 | B1.0\_REF99\_V4\_2831 | 39 | 42 | 39 | 13 | | | | | | | | | 22 | 37 | 22 | 5 | | | | | | | | |
| 321 | 810 | B1.0\_REF99\_V4\_250 | 615 | B1.0\_REF99\_V4\_3374 | 39 | 34 | 31 | 10 | | | | | | | | | | | | | | | | | | | | |
| 322 | 810 | B1.0\_REF99\_V4\_250 | 916 | B1.0\_REF99\_V4\_43675 | 39 | 40 | 37 | 12 | | | | | | | | | 22 | 37 | 22 | 5 | | | | | | | | |
| 323 | 810 | B1.0\_REF99\_V4\_250 | 880 | B1.0\_REF99\_V4\_4472 | 39 | 31 | 30 | 10 | | | | | | | | | | | | | | | | | | | | |
| 324 | 810 | B1.0\_REF99\_V4\_250 | 1012 | B1.0\_REF99\_V4\_597 | 39 | 39 | 37 | 12 | | | | | | | | | 22 | 34 | 22 | 5 | | | | | | | | |
| 325 | 810 | B1.0\_REF99\_V4\_250 | 837 | B1.0\_REF99\_V4\_720 | 39 | 55 | 39 | 17 | | | | | | | | | | | | | | | | | | | | |
| 326 | 810 | B1.0\_REF99\_V4\_250 | 713 | B1.0\_REF99\_V4\_754 | 39 | 36 | 31 | 11 | | | | | | | | | | | | | | | | | | | | |
| 327 | 810 | B1.0\_REF99\_V4\_250 | 915 | B1.0\_REF99\_V4\_884 | 39 | 27 | 24 | 8 | | | | | | | | | | | | | | | | | | | | |
| 328 | 810 | B1.0\_REF99\_V4\_250 | 1007 | B1.0\_REF99\_V4\_9526 | 39 | 42 | 36 | 13 | | | | | | | | | | | | | | | | | | | | |

TABLE 12-continued

| A | B | C | D | E | F Bacteria - cultivated | | | G Bacteria - cultivated, roots | | | H Bacteria - cultivated, seeds | | | I Bacteria - wild | | | | J Bacteria - wild, roots | | | | K Bacteria - wild, seeds | | | |
|---|---|---|---|---|---|---|---|---|---|---|---|---|---|---|---|---|---|---|---|---|---|---|---|---|---|
| PAIR | Endophyte 1 (SEQ ID NO:) | Endophyte 1 (OTU) | Endophyte 2 (SEQ ID NO:) | Endophyte 2 (OTU) | N1 | N2 OC | EC | N1 | N2 OC | EC | N1 | N2 OC | EC | N1 | N2 | OC | EC | N1 | N2 | OC | EC | N1 | N2 | OC | EC |
| 329 | 131 | B1.0|REF99_V4|251 | 974 | B1.0|REF99_V4|2831 | 33 | 42 | 29 | 11 | | | | | | | | 30 | 37 | 24 | 7 | | | | | | | | |
| 330 | 131 | B1.0|REF99_V4|251 | 615 | B1.0|REF99_V4|3374 | 33 | 34 | 23 | 9 | | | | | | | | 30 | 37 | 24 | 7 | | | | | | | | |
| 331 | 131 | B1.0|REF99_V4|251 | 916 | B1.0|REF99_V4|3675 | 33 | 40 | 27 | 10 | | | | | | | | | | | | | | | | | | | |
| 332 | 131 | B1.0|REF99_V4|251 | 1012 | B1.0|REF99_V4|4597 | 33 | 39 | 26 | 10 | | | | | | | | | | | | | | | | | | | |
| 333 | 131 | B1.0|REF99_V4|251 | 837 | B1.0|REF99_V4|4720 | 33 | 55 | 31 | 14 | | | | | | | | | | | | | | | | | | | |
| 334 | 131 | B1.0|REF99_V4|251 | 713 | B1.0|REF99_V4|4754 | 33 | 36 | 25 | 9 | | | | | | | | 30 | 37 | 24 | 7 | | | | | | | | |
| 335 | 131 | B1.0|REF99_V4|251 | 1007 | B1.0|REF99_V4|49526 | 33 | 42 | 28 | 11 | | | | | | | | | | | | | | | | | | | |
| 336 | 1109 | B1.0|REF99_V4|25629 | 1095 | B1.0|REF99_V4|54497 | | | | | | | | | | | | 81 | 64 | 55 | 32 | | | | | 81 | 64 | 55 | 42 |
| 337 | 1086 | B1.0|REF99_V4|25794 | 1093 | B1.0|REF99_V4|429 | | | | | | | | | | | | 47 | 44 | 35 | 13 | | | | | 47 | 43 | 35 | 16 |
| 338 | 943 | B1.0|REF99_V4|26030 | 974 | B1.0|REF99_V4|2831 | 31 | 42 | 31 | 10 | | | | | | | | 32 | 37 | 32 | 7 | | | | | | | | |
| 339 | 943 | B1.0|REF99_V4|26030 | 615 | B1.0|REF99_V4|3374 | 31 | 34 | 27 | 8 | | | | | | | | 32 | 30 | 26 | 6 | | | | | | | | |
| 340 | 943 | B1.0|REF99_V4|26030 | 963 | B1.0|REF99_V4|33855 | 31 | 27 | 21 | 7 | | | | | | | | 32 | 31 | 23 | 6 | | | | | | | | |
| 341 | 943 | B1.0|REF99_V4|26030 | 916 | B1.0|REF99_V4|3675 | 31 | 40 | 31 | 10 | | | | | | | | 32 | 37 | 32 | 7 | | | | | | | | |
| 342 | 943 | B1.0|REF99_V4|26030 | 880 | B1.0|REF99_V4|4472 | 31 | 23 | 23 | 8 | | | | | | | | 32 | 31 | 23 | 6 | | | | | | | | |
| 343 | 943 | B1.0|REF99_V4|26030 | 69 | B1.0|REF99_V4|4506 | | | | | | | | | | | | 32 | 33 | 27 | 7 | | | | | | | | |
| 344 | 943 | B1.0|REF99_V4|26030 | 1012 | B1.0|REF99_V4|4597 | 31 | 39 | 28 | 10 | | | | | | | | 32 | 34 | 29 | 7 | | | | | | | | |
| 345 | 943 | B1.0|REF99_V4|26030 | 837 | B1.0|REF99_V4|4720 | 31 | 55 | 31 | 13 | | | | | | | | 32 | 69 | 32 | 14 | | | | | | | | |
| 346 | 943 | B1.0|REF99_V4|26030 | 713 | B1.0|REF99_V4|4754 | 31 | 36 | 25 | 9 | | | | | | | | 32 | 37 | 26 | 7 | | | | | | | | |
| 347 | 943 | B1.0|REF99_V4|26030 | 915 | B1.0|REF99_V4|4884 | | | | | | | | | | | | 32 | 28 | 24 | 6 | | | | | | | | |
| 348 | 943 | B1.0|REF99_V4|26030 | 1007 | B1.0|REF99_V4|49526 | 31 | 42 | 29 | 10 | | | | | | | | 32 | 41 | 29 | 8 | | | | | | | | |
| 349 | 943 | B1.0|REF99_V4|26030 | 615 | B1.0|REF99_V4|3374 | 42 | 34 | 34 | 11 | | | | | | | | 37 | 30 | 30 | 7 | | | | | | | | |
| 350 | 974 | B1.0|REF99_V4|2831 | 963 | B1.0|REF99_V4|33855 | 42 | 27 | 27 | 9 | | | | | | | | 37 | 31 | 31 | 7 | | | | | | | | |
| 351 | 974 | B1.0|REF99_V4|2831 | 961 | B1.0|REF99_V4|43580 | 42 | 21 | 21 | 7 | | | | | | | | 37 | 21 | 21 | 5 | | | | | | | | |
| 352 | 974 | B1.0|REF99_V4|2831 | 916 | B1.0|REF99_V4|3675 | 42 | 40 | 40 | 13 | | | | | | | | 37 | 37 | 37 | 9 | | | | | | | | |
| 353 | 974 | B1.0|REF99_V4|2831 | 945 | B1.0|REF99_V4|4442 | 42 | 27 | 27 | 9 | | | | | | | | | | | | | | | | | | | |
| 354 | 974 | B1.0|REF99_V4|2831 | 880 | B1.0|REF99_V4|4472 | 42 | 31 | 31 | 10 | | | | | | | | 37 | 31 | 26 | 7 | | | | | | | | |
| 355 | 974 | B1.0|REF99_V4|2831 | 69 | B1.0|REF99_V4|4506 | 42 | 25 | 24 | 8 | | | | | | | | 37 | 33 | 32 | 8 | | | | | | | | |
| 356 | 974 | B1.0|REF99_V4|2831 | 60 | B1.0|REF99_V4|4514 | 42 | 23 | 23 | 8 | | | | | | | | | | | | | | | | | | | |
| 357 | 974 | B1.0|REF99_V4|2831 | 1012 | B1.0|REF99_V4|4597 | 42 | 39 | 39 | 13 | | | | | | | | 37 | 34 | 34 | 8 | | | | | | | | |
| 358 | 974 | B1.0|REF99_V4|2831 | 319 | B1.0|REF99_V4|70731 | 42 | 24 | 24 | 8 | | | | | | | | 37 | 21 | 21 | 5 | | | | | | | | |
| 359 | 974 | B1.0|REF99_V4|2831 | 837 | B1.0|REF99_V4|4720 | 42 | 55 | 42 | 18 | | | | | | | | 37 | 69 | 37 | 16 | | | | | | | | |
| 360 | 974 | B1.0|REF99_V4|2831 | 713 | B1.0|REF99_V4|4754 | 42 | 36 | 34 | 12 | | | | | | | | 37 | 37 | 31 | 9 | | | | | | | | |
| 361 | 974 | B1.0|REF99_V4|2831 | 915 | B1.0|REF99_V4|4884 | 42 | 27 | 27 | 9 | | | | | | | | 37 | 28 | 28 | 7 | | | | | | | | |
| 362 | 974 | B1.0|REF99_V4|2831 | 1007 | B1.0|REF99_V4|49526 | 42 | 42 | 39 | 14 | | | | | | | | 37 | 41 | 33 | 10 | | | | | | | | |
| 363 | 974 | B1.0|REF99_V4|284 | 826 | B1.0|REF99_V4|4467 | | | | | | | | | | | | 55 | 52 | 41 | 18 | | | | | | | | |
| 364 | 1175 | B1.0|REF99_V4|284 | 1199 | B1.0|REF99_V4|4589 | | | | | | | | | | | | 55 | 39 | 35 | 13 | | | | | | | | |
| 365 | 615 | B1.0|REF99_V4|3374 | 963 | B1.0|REF99_V4|33855 | 34 | 27 | 25 | 7 | | | | | | | | 30 | 31 | 22 | 6 | | | | | | | | |
| 366 | 615 | B1.0|REF99_V4|3374 | 916 | B1.0|REF99_V4|3675 | 34 | 40 | 33 | 11 | | | | | | | | 30 | 37 | 30 | 7 | | | | | | | | |
| 367 | 615 | B1.0|REF99_V4|3374 | 880 | B1.0|REF99_V4|4472 | 34 | 31 | 26 | 8 | | | | | | | | 30 | 31 | 22 | 6 | | | | | | | | |
| 368 | 615 | B1.0|REF99_V4|3374 | 69 | B1.0|REF99_V4|4506 | 34 | 25 | 20 | 7 | | | | | | | | 30 | 33 | 26 | 6 | | | | | | | | |
| 369 | 615 | B1.0|REF99_V4|3374 | 1012 | B1.0|REF99_V4|4597 | 34 | 39 | 31 | 10 | | | | | | | | 30 | 34 | 29 | 6 | | | | | | | | |
| 370 | 615 | B1.0|REF99_V4|3374 | 837 | B1.0|REF99_V4|4720 | 34 | 55 | 34 | 15 | | | | | | | | 30 | 69 | 30 | 13 | | | | | | | | |
| 371 | 615 | B1.0|REF99_V4|3374 | 713 | B1.0|REF99_V4|4754 | 34 | 36 | 29 | 10 | | | | | | | | 30 | 37 | 25 | 7 | | | | | | | | |
| 372 | 615 | B1.0|REF99_V4|3374 | 915 | B1.0|REF99_V4|4884 | 34 | 27 | 22 | 7 | | | | | | | | 30 | 28 | 22 | 5 | | | | | | | | |
| 373 | 615 | B1.0|REF99_V4|3374 | 1007 | B1.0|REF99_V4|49526 | 34 | 42 | 32 | 11 | | | | | | | | 30 | 41 | 26 | 8 | | | | | | | | |
| 374 | 963 | B1.0|REF99_V4|33855 | 916 | B1.0|REF99_V4|3675 | 27 | 40 | 27 | 9 | | | | | | | | 31 | 37 | 27 | 7 | | | | | | | | |

TABLE 12-continued

| PAIR | B Endophyte 1 (SEQ ID NO:) | C Endophyte 1 (OTU) | D Endophyte 2 (SEQ ID NO:) | E Endophyte 2 (OTU) | F Bacteria - cultivated | | | | G Bacteria - cultivated, roots | | | | H Bacteria - cultivated, seeds | | | | I Bacteria - wild | | | | J Bacteria - wild, roots | | | | K Bacteria - wild, seeds | | | |
|---|---|---|---|---|---|---|---|---|---|---|---|---|---|---|---|---|---|---|---|---|---|---|---|---|---|---|---|---|
| | | | | | N1 | N2 | OC | EC | N1 | N2 | OC | EC | N1 | N2 | OC | EC | N1 | N2 | OC | EC | N1 | N2 | OC | EC | N1 | N2 | OC | EC |
| 375 | 963 | B1.0\|REF99_V4\|33855 | 1012 | B1.0\|REF99_V4\|597 | 27 | 39 | 24 | 8 | | | | | | | | | 31 | 34 | 26 | 7 | | | | | | | | |
| 376 | 963 | B1.0\|REF99_V4\|33855 | 713 | B1.0\|REF99_V4\|754 | 27 | 36 | 23 | 8 | | | | | | | | | | | | | | | | | | | | |
| 377 | 963 | B1.0\|REF99_V4\|33855 | 1007 | B1.0\|REF99_V4\|9526 | 27 | 42 | 26 | 9 | | | | | | | | | 31 | 41 | 26 | 8 | | | | | | | | |
| 378 | 916 | B1.0\|REF99_V4\|3675 | 945 | B1.0\|REF99_V4\|442 | 40 | 31 | 29 | 9 | | | | | | | | | | | | | | | | | | | | |
| 379 | 916 | B1.0\|REF99_V4\|3675 | 880 | B1.0\|REF99_V4\|472 | 40 | 25 | 23 | 10 | | | | | | | | | 37 | 31 | 26 | 7 | | | | | | | | |
| 380 | 916 | B1.0\|REF99_V4\|3675 | 69 | B1.0\|REF99_V4\|506 | 40 | 39 | 37 | 8 | | | | | | | | | 37 | 33 | 32 | 8 | | | | | | | | |
| 381 | 916 | B1.0\|REF99_V4\|3675 | 1012 | B1.0\|REF99_V4\|597 | 40 | 24 | 23 | 12 | | | | | | | | | 37 | 34 | 34 | 8 | | | | | | | | |
| 382 | 916 | B1.0\|REF99_V4\|3675 | 319 | B1.0\|REF99_V4\|70731 | 40 | 55 | 40 | 17 | | | | | | | | | 37 | 21 | 21 | 5 | | | | | | | | |
| 383 | 916 | B1.0\|REF99_V4\|3675 | 837 | B1.0\|REF99_V4\|720 | 40 | 36 | 32 | 11 | | | | | | | | | 37 | 69 | 37 | 16 | | | | | | | | |
| 384 | 916 | B1.0\|REF99_V4\|3675 | 713 | B1.0\|REF99_V4\|754 | 40 | 27 | 25 | 9 | | | | | | | | | 37 | 37 | 31 | 9 | | | | | | | | |
| 385 | 916 | B1.0\|REF99_V4\|3675 | 915 | B1.0\|REF99_V4\|884 | 40 | 42 | 38 | 13 | | | | | | | | | 37 | 28 | 28 | 7 | | | | | | | | |
| 386 | 916 | B1.0\|REF99_V4\|3675 | 1007 | B1.0\|REF99_V4\|9526 | 40 | 42 | 38 | 13 | | | | | | | | | 37 | 41 | 33 | 10 | | | | | | | | |
| 387 | 945 | B1.0\|REF99_V4\|442 | 1012 | B1.0\|REF99_V4\|597 | 27 | 39 | 25 | 8 | | | | | | | | | | | | | | | | | | | | |
| 388 | 880 | B1.0\|REF99_V4\|472 | 1012 | B1.0\|REF99_V4\|597 | 31 | 39 | 29 | 10 | | | | | | | | | 31 | 34 | 23 | 7 | | | | | | | | |
| 389 | 880 | B1.0\|REF99_V4\|472 | 837 | B1.0\|REF99_V4\|720 | 31 | 55 | 31 | 13 | | | | | | | | | | | | | | | | | | | | |
| 390 | 880 | B1.0\|REF99_V4\|472 | 713 | B1.0\|REF99_V4\|754 | 31 | 25 | 25 | 9 | | | | | | | | | | | | | | | | | | | | |
| 391 | 880 | B1.0\|REF99_V4\|472 | 915 | B1.0\|REF99_V4\|884 | 31 | 36 | 25 | 9 | | | | | | | | | | | | | | | | | | | | |
| 392 | 880 | B1.0\|REF99_V4\|472 | 1007 | B1.0\|REF99_V4\|9526 | 31 | 42 | 28 | 10 | | | | | | | | | | | | | | | | | | | | |
| 393 | 69 | B1.0\|REF99_V4\|506 | 1012 | B1.0\|REF99_V4\|597 | 25 | 39 | 23 | 8 | | | | | | | | | 33 | 34 | 31 | 7 | | | | | | | | |
| 394 | 69 | B1.0\|REF99_V4\|506 | 837 | B1.0\|REF99_V4\|720 | 25 | 55 | 25 | 11 | | | | | | | | | 33 | 69 | 32 | 14 | | | | | | | | |
| 395 | 69 | B1.0\|REF99_V4\|506 | 713 | B1.0\|REF99_V4\|754 | | | | | | | | | | | | | 33 | 37 | 29 | 8 | | | | | | | | |
| 396 | 69 | B1.0\|REF99_V4\|506 | 915 | B1.0\|REF99_V4\|884 | | | | | | | | | | | | | 33 | 28 | 27 | 6 | | | | | | | | |
| 397 | 69 | B1.0\|REF99_V4\|506 | 1007 | B1.0\|REF99_V4\|9526 | 25 | 42 | 23 | 8 | | | | | | | | | 33 | 41 | 29 | 9 | | | | | | | | |
| 398 | 818 | B1.0\|REF99_V4\|531 | 837 | B1.0\|REF99_V4\|720 | 38 | 55 | 35 | 17 | | | | | | | | | | | | | | | | | | | | |
| 399 | 702 | B1.0\|REF99_V4\|5579 | 1134 | B1.0\|REF99_V4\|986 | | | | | | | | | 20 | 17 | 16 | 4 | | | | | 42 | 41 | 36 | 14 | | | | |
| 400 | 1012 | B1.0\|REF99_V4\|597 | 837 | B1.0\|REF99_V4\|720 | 39 | 55 | 39 | 17 | | | | | | | | | 42 | 51 | 36 | 13 | | | | | | | | |
| 401 | 1012 | B1.0\|REF99_V4\|597 | 713 | B1.0\|REF99_V4\|754 | 39 | 36 | 31 | 11 | | | | | | | | | 34 | 69 | 34 | 15 | | | | | | | | |
| 402 | 1012 | B1.0\|REF99_V4\|597 | 915 | B1.0\|REF99_V4\|884 | 39 | 27 | 24 | 8 | | | | | | | | | 34 | 37 | 29 | 8 | | | | | | | | |
| 403 | 1012 | B1.0\|REF99_V4\|597 | 1007 | B1.0\|REF99_V4\|9526 | 39 | 42 | 36 | 13 | | | | | | | | | 34 | 28 | 27 | 6 | | | | | | | | |
| 404 | 319 | B1.0\|REF99_V4\|70731 | 1007 | B1.0\|REF99_V4\|9526 | 24 | 42 | 23 | 8 | | | | | | | | | 34 | 41 | 30 | 9 | | | | | | | | |
| 405 | 837 | B1.0\|REF99_V4\|720 | 1007 | B1.0\|REF99_V4\|9526 | 55 | 36 | 34 | 16 | | | | | | | | | | | | | | | | | | | | |
| 406 | 837 | B1.0\|REF99_V4\|720 | 837 | B1.0\|REF99_V4\|720 | 55 | 27 | 27 | 12 | | | | | | | | | | | | | | | | | | | | |
| 407 | 837 | B1.0\|REF99_V4\|720 | 915 | B1.0\|REF99_V4\|884 | 55 | 42 | 41 | 18 | | | | | | | | | 69 | 41 | 36 | 18 | | | | | | | | |
| 408 | 713 | B1.0\|REF99_V4\|754 | 1007 | B1.0\|REF99_V4\|9526 | 36 | 27 | 26 | 8 | | | | | | | | | 37 | 28 | 26 | 7 | | | | | | | | |
| 409 | 713 | B1.0\|REF99_V4\|754 | 1007 | B1.0\|REF99_V4\|9526 | 36 | 42 | 31 | 12 | | | | | | | | | 37 | 41 | 28 | 10 | | | | | | | | |
| 410 | 915 | B1.0\|REF99_V4\|884 | 1007 | B1.0\|REF99_V4\|9526 | 27 | 42 | 25 | 9 | | | | | | | | | 28 | 41 | 27 | 7 | | | | | | | | |
| 413 | 1108 | B1.0\|REF97_V4\|41 | 1113 | B1.0\|REF99_V4\|52497 | | | | | | | | | | | | | 39 | 25 | 23 | 6 | | | | | | | | |
| 421 | 1089 | B1.0\|REF97_V4\|127 | 1112 | B1.0\|REF99_V4\|14460 | | | | | | | | | 29 | 40 | 23 | 14 | | | | | | | | | 32 | 25 | 23 | 7 |
| 429 | 1098 | B1.0\|REF97_V4\|171 | 1104 | B1.0\|REF99_V4\|122519 | | | | | | | | | 19 | 22 | 18 | 5 | | | | | | | | | 23 | 29 | 19 | 5 |
| 432 | 1098 | B1.0\|REF97_V4\|171 | 1105 | B1.0\|REF99_V4\|4080 | | | | | | | | | | | | | | | | | | | | | 23 | 25 | 17 | 5 |
| 464 | 1110 | B1.0\|REF99_V4\|108549 | 1113 | B1.0\|REF99_V4\|52497 | | | | | | | | | | | | | 38 | 25 | 23 | 6 | | | | | 38 | 25 | 23 | 8 |
| 473 | 982 | B1.0\|REF99_V4\|118 | 972 | B1.0\|REF99_V4\|218 | | | | | | | | | | | | | 83 | 63 | 53 | 33 | | | | | | | | |
| 480 | 1104 | B1.0\|REF99_V4\|122519 | 1105 | B1.0\|REF99_V4\|4080 | | | | | | | | | | | | | | | | | | | | | 29 | 25 | 20 | 6 |
| 483 | 1158 | B1.0\|REF99_V4\|1323 | 1191 | B1.0\|REF99_V4\|150716 | | | | | | | | | 31 | 31 | 21 | 11 | | | | | | | | | | | | |
| 485 | 1112 | B1.0\|REF99_V4\|14460 | 1191 | B1.0\|REF99_V4\|150716 | 40 | 32 | 23 | 10 | | | | | | | | | | | | | | | | | | | | |
| 494 | 1191 | B1.0\|REF99_V4\|150716 | 702 | B1.0\|REF99_V4\|5579 | | | | | | | | | | | | | 53 | 42 | 33 | 14 | | | | | 53 | 42 | 33 | 18 |
| 498 | 1098 | B1.0\|REF97_V4\|171 | 1106 | B1.0\|REF99_V4\|466 | | | | | | | | | | | | | | | | | | | | | 86 | 94 | 79 | 66 |

TABLE 12-continued

| A | B<br>Endophyte | C<br>Endophyte | D<br>Endophyte | E<br>Endophyte | F<br>Bacteria -<br>cultivated | | | | G<br>Bacteria -<br>cultivated,<br>roots | | | | H<br>Bacteria -<br>cultivated,<br>seeds | | | | I<br>Bacteria -<br>wild | | | | J<br>Bacteria -<br>wild, roots | | | | K<br>Bacteria -<br>wild, seeds | | | |
|---|---|---|---|---|---|---|---|---|---|---|---|---|---|---|---|---|---|---|---|---|---|---|---|---|---|---|---|---|
| PAIR | 1 (SEQ ID NO:) | 1 (OTU) | 2 (SEQ ID NO:) | 2 (OTU) | N1 | N2 | OC | EC | N1 | N2 | OC | EC | N1 | N2 | OC | EC | N1 | N2 | OC | EC | N1 | N2 | OC | EC | N1 | N2 | OC | EC |
| 502 | 1175 | B1.0|REF99_V4|284 | 1095 | B1.0|REF99_V4|54497 | | | | | | | | | | | | | 33 | 28 | 20 | 11 | 55 | 64 | 38 | 22 | | | | |
| 511 | 1201 | B1.0|REF99_V4|442 | 1163 | B1.0|REF99_V4|6806 | | | | | | | | | | | | | | | | | | | | | | | | |
| 519 | 959 | B1.0|REF97_V4|126 | 974 | B1.0|REF97_V4|2831 | 22 | 42 | 22 | | | | | | | | | | | | | | | | | | | | | |
| 520 | 959 | B1.0|REF97_V4|126 | 916 | B1.0|REF97_V4|3675 | 22 | 37 | 20 | 6 | | | | | | | | | | | | | | | | | | | | |
| 521 | 959 | B1.0|REF97_V4|126 | 959 | B1.0|REF97_V4|126 | 22 | 37 | 22 | 6 | | | | | | | | | | | | | | | | | | | | |
| 522 | 959 | B1.0|REF97_V4|126 | 116 | B1.0|REF99_V4|1567 | 22 | 35 | 21 | 7 | | | | | | | | | | | | | | | | | | | | |
| 523 | 959 | B1.0|REF97_V4|126 | 789 | B1.0|REF99_V4|21172 | 22 | 42 | 21 | 7 | | | | | | | | | | | | | | | | | | | | |
| 524 | 959 | B1.0|REF97_V4|126 | 810 | B1.0|REF99_V4|4250 | 22 | 39 | 22 | 7 | | | | | | | | | | | | | | | | | | | | |
| 525 | 959 | B1.0|REF97_V4|126 | 974 | B1.0|REF97_V4|2831 | 22 | 42 | 22 | 7 | | | | | | | | | | | | | | | | | | | | |
| 526 | 959 | B1.0|REF97_V4|126 | 916 | B1.0|REF97_V4|3675 | 22 | 40 | 21 | 7 | | | | | | | | | | | | | | | | | | | | |
| 527 | 959 | B1.0|REF97_V4|126 | 1012 | B1.0|REF97_V4|597 | 22 | 39 | 21 | 7 | | | | | | | | | | | | | | | | | | | | |
| 528 | 959 | B1.0|REF97_V4|126 | 1007 | B1.0|REF99_V4|9526 | 22 | 42 | 20 | 7 | | | | | | | | | | | | | | | | | | | | |
| 529 | 260 | B1.0|REF97_V4|14662 | 260 | B1.0|REF99_V4|14662 | 20 | 43 | 20 | 7 | | | | | 12 | 18 | 12 | 3 | | | | | | | | | | | | |
| 530 | 1191 | B1.0|REF97_V4|150716 | 510 | B1.0|REF97_V4|8981 | 28 | 24 | 19 | 5 | | | | | 28 | 23 | 19 | 8 | | | | | | | | | | | | |
| 531 | 1191 | B1.0|REF97_V4|150716 | 1112 | B1.0|REF99_V4|14460 | 28 | 40 | 22 | 9 | | | | | 28 | 40 | 22 | 13 | | | | | | | | | | | | |
| 532 | 1191 | B1.0|REF97_V4|150716 | 510 | B1.0|REF97_V4|8981 | 28 | 30 | 20 | 7 | | | | | 28 | 26 | 20 | 9 | | | | | 50 | 41 | 29 | 17 |
| 533 | 1098 | B1.0|REF97_V4|171 | 1092 | B1.0|REF99_V4|476 | 36 | 34 | 25 | 10 | | | | | 19 | 26 | 17 | 6 | | | | | | | | | | | | |
| 534 | 313 | B1.0|REF97_V4|18024 | 974 | B1.0|REF97_V4|2831 | 20 | 42 | 20 | 7 | | | | | | | | | | | | | | | | | | | | |
| 535 | 313 | B1.0|REF97_V4|18024 | 71 | B1.0|REF99_V4|1351 | 20 | 38 | 19 | 6 | | | | | | | | | | | | | | | | | | | | |
| 536 | 313 | B1.0|REF97_V4|18024 | 810 | B1.0|REF99_V4|4250 | 20 | 39 | 19 | 6 | | | | | | | | | | | | | | | | | | | | |
| 537 | 313 | B1.0|REF97_V4|18024 | 974 | B1.0|REF97_V4|2831 | 20 | 42 | 20 | 7 | | | | | | | | | | | | | | | | | | | | |
| 538 | 313 | B1.0|REF97_V4|18024 | 916 | B1.0|REF97_V4|3675 | 20 | 40 | 19 | 6 | | | | | | | | | | | | | | | | | | | | |
| 539 | 974 | B1.0|REF97_V4|2831 | 1012 | B1.0|REF97_V4|597 | 42 | 23 | 23 | 8 | | | | | | | | | | | | | | | | | | | | |
| 540 | 974 | B1.0|REF97_V4|2831 | 962 | B1.0|REF99_V4|102519 | 42 | 19 | 19 | 7 | | | | | | | | | | | | | | | | | | | | |
| 541 | 974 | B1.0|REF97_V4|2831 | 892 | B1.0|REF99_V4|1177 | 42 | 21 | 21 | 7 | | | | | | | | | | | | | | | | | | | | |
| 542 | 974 | B1.0|REF97_V4|2831 | 54 | B1.0|REF99_V4|118524 | 42 | 22 | 22 | 7 | | | | | | | | | | | | | | | | | | | | |
| 543 | 974 | B1.0|REF97_V4|2831 | 839 | B1.0|REF99_V4|11186 | 42 | 30 | 24 | 10 | | | | | | | | | | | | | | | | | | | | |
| 544 | 974 | B1.0|REF97_V4|2831 | 939 | B1.0|REF99_V4|11317 | 42 | 32 | 26 | 11 | | | | | | | | | | | | | | | | | | | | |
| 545 | 974 | B1.0|REF97_V4|2831 | 1013 | B1.0|REF99_V4|13951 | 42 | 21 | 21 | 7 | | | | | | | | | | | | | | | | | | | | |
| 546 | 974 | B1.0|REF97_V4|2831 | 814 | B1.0|REF99_V4|11673 | 42 | 25 | 25 | 8 | | | | | | | | | | | | | | | | | | | | |
| 547 | 974 | B1.0|REF97_V4|2831 | 59 | B1.0|REF99_V4|171149 | 42 | 21 | 21 | 7 | | | | | | | | | | | | | | | | | | | | |
| 548 | 974 | B1.0|REF97_V4|2831 | 684 | B1.0|REF99_V4|4172 | 42 | 75 | 41 | 25 | | | | | | | | | | | | | | | | | | | | |
| 549 | 974 | B1.0|REF97_V4|2831 | 313 | B1.0|REF97_V4|18024 | 42 | 21 | 21 | 7 | | | | | | | | | | | | | | | | | | | | |
| 550 | 974 | B1.0|REF97_V4|2831 | 613 | B1.0|REF99_V4|2200 | 42 | 22 | 22 | 7 | | | | | | | | | | | | | | | | | | | | |
| 551 | 974 | B1.0|REF97_V4|2831 | 887 | B1.0|REF99_V4|2238 | 42 | 19 | 19 | 6 | | | | | | | | | | | | | | | | | | | | |
| 552 | 974 | B1.0|REF97_V4|2831 | 681 | B1.0|REF99_V4|2234 | 42 | 46 | 30 | 15 | | | | | | | | | | | | | | | | | | | | |
| 553 | 974 | B1.0|REF97_V4|2831 | 845 | B1.0|REF99_V4|2959 | 42 | 25 | 25 | 8 | | | | | | | | | | | | | | | | | | | | |
| 554 | 974 | B1.0|REF97_V4|2831 | 719 | B1.0|REF99_V4|385 | 42 | 52 | 31 | 17 | | | | | | | | | | | | | | | | | | | | |
| 555 | 974 | B1.0|REF97_V4|2831 | 818 | B1.0|REF99_V4|531 | 42 | 38 | 27 | 13 | | | | | | | | | | | | | | | | | | | | |
| 556 | 974 | B1.0|REF97_V4|2831 | 734 | B1.0|REF99_V4|558 | 42 | 32 | 26 | 11 | | | | | | | | | | | | | | | | | | | | |
| 557 | 974 | B1.0|REF97_V4|2831 | 775 | B1.0|REF99_V4|635 | 42 | 21 | 21 | 7 | | | | | | | | | | | | | | | | | | | | |
| 558 | 974 | B1.0|REF97_V4|2831 | 1012 | B1.0|REF97_V4|597 | 42 | 23 | 20 | 7 | | | | | | | | | | | | | | | | | | | | |
| 559 | 916 | B1.0|REF97_V4|3675 | 892 | B1.0|REF99_V4|1177 | 37 | 21 | 20 | 6 | | | | | | | | | | | | | | | | | | | | |
| 560 | 916 | B1.0|REF97_V4|3675 | 54 | B1.0|REF99_V4|118524 | 37 | 22 | 20 | 6 | | | | | | | | | | | | | | | | | | | | |
| 561 | 916 | B1.0|REF97_V4|3675 | 939 | B1.0|REF99_V4|11317 | 37 | 32 | 22 | 9 | | | | | | | | | | | | | | | | | | | | |
| 562 | 916 | B1.0|REF97_V4|3675 | 1013 | B1.0|REF99_V4|13951 | 37 | 21 | 19 | 6 | | | | | | | | | | | | | | | | | | | | |

TABLE 12-continued

| A | B | C | D | E | F Bacteria - cultivated | | | | G Bacteria - cultivated, roots | | | | H Bacteria - cultivated, seeds | | | | I Bacteria - wild | | | | J Bacteria - wild, roots | | | | K Bacteria - wild, seeds | | | |
|---|---|---|---|---|---|---|---|---|---|---|---|---|---|---|---|---|---|---|---|---|---|---|---|---|---|---|---|---|---|
| PAIR | Endophyte 1 (SEQ ID NO:) | Endophyte 1 (OTU) | Endophyte 2 (SEQ ID NO:) | Endophyte 2 (OTU) | N1 | N2 | OC | EC | N1 | N2 | OC | EC | N1 | N2 | OC | EC | N1 | N2 | OC | EC | N1 | N2 | OC | EC | N1 | N2 | OC | EC |
| 563 | 916 | B1.0|REF97_V4|3675 | 814 | B1.0|REF99_V4|1673 | 37 | 25 | 23 | 7 | | | | | | | | | | | | | | | | | | | | |
| 564 | 916 | B1.0|REF97_V4|3675 | 59 | B1.0|REF99_V4|171149 | 37 | 21 | 19 | 6 | | | | | | | | | | | | | | | | | | | | |
| 565 | 916 | B1.0|REF97_V4|3675 | 684 | B1.0|REF99_V4|172 | 37 | 75 | 36 | 22 | | | | | | | | | | | | | | | | | | | | |
| 566 | 916 | B1.0|REF97_V4|3675 | 681 | B1.0|REF99_V4|234 | 37 | 46 | 27 | 13 | | | | | | | | | | | | | | | | | | | | |
| 567 | 916 | B1.0|REF97_V4|3675 | 845 | B1.0|REF99_V4|2959 | 37 | 25 | 21 | 7 | | | | | | | | | | | | | | | | | | | | |
| 568 | 916 | B1.0|REF97_V4|3675 | 961 | B1.0|REF99_V4|3580 | 37 | 21 | 19 | 6 | | | | | | | | | | | | | | | | | | | | |
| 569 | 916 | B1.0|REF97_V4|3675 | 734 | B1.0|REF99_V4|558 | 37 | 32 | 23 | 9 | | | | | | | | | | | | | | | | | | | | |
| 570 | 1012 | B1.0|REF97_V4|597 | 837 | B1.0|REF99_V4|720 | 23 | 43 | 22 | 8 | | | | | | | | | | | | | | | | | | | | |
| 571 | 1012 | B1.0|REF97_V4|597 | 137 | B1.0|REF99_V4|411 | 23 | 53 | 23 | 10 | | | | | | | | | | | | | | | | | | | | |
| 572 | 1012 | B1.0|REF97_V4|597 | 959 | B1.0|REF99_V4|126 | 23 | 37 | 22 | 7 | | | | | | | | | | | | | | | | | | | | |
| 573 | 1012 | B1.0|REF97_V4|597 | 116 | B1.0|REF99_V4|1567 | 23 | 35 | 21 | 6 | | | | | | | | | | | | | | | | | | | | |
| 574 | 1012 | B1.0|REF97_V4|597 | 789 | B1.0|REF99_V4|2172 | 23 | 42 | 21 | 8 | | | | | | | | | | | | | | | | | | | | |
| 575 | 1012 | B1.0|REF97_V4|597 | 810 | B1.0|REF99_V4|250 | 23 | 39 | 22 | 7 | | | | | | | | | | | | | | | | | | | | |
| 576 | 1012 | B1.0|REF97_V4|597 | 974 | B1.0|REF99_V4|2831 | 23 | 42 | 23 | 8 | | | | | | | | | | | | | | | | | | | | |
| 577 | 1012 | B1.0|REF97_V4|597 | 916 | B1.0|REF99_V4|3675 | 23 | 40 | 21 | 7 | | | | | | | | | | | | | | | | | | | | |
| 578 | 1012 | B1.0|REF97_V4|597 | 880 | B1.0|REF99_V4|472 | 23 | 31 | 19 | 6 | | | | | | | | | | | | | | | | | | | | |
| 579 | 1012 | B1.0|REF97_V4|597 | 1012 | B1.0|REF99_V4|597 | 23 | 39 | 23 | 7 | | | | | | | | | | | | | | | | | | | | |
| 580 | 1012 | B1.0|REF97_V4|597 | 837 | B1.0|REF99_V4|720 | 23 | 55 | 23 | 10 | | | | | | | | | | | | | | | | | | | | |
| 581 | 1012 | B1.0|REF97_V4|597 | 1007 | B1.0|REF99_V4|9526 | 23 | 42 | 21 | 8 | | | | | | | | | | | | | | | | | | | | |
| 582 | 1106 | B1.0|REF97_V4|66 | 837 | B1.0|REF99_V4|720 | 60 | 43 | 34 | 20 | | | | | | | | | | | | | | | | | | | | |
| 583 | 1106 | B1.0|REF97_V4|66 | 121 | B1.0|REF99_V4|1211 | 60 | 46 | 35 | 22 | | | | | | | | | | | | | | | | | | | | |
| 584 | 1106 | B1.0|REF97_V4|66 | 1184 | B1.0|REF99_V4|20510 | 60 | 34 | 30 | 16 | | | | | | | | | | | | | | | | | | | | |
| 585 | 837 | B1.0|REF97_V4|720 | 837 | B1.0|REF99_V4|720 | 60 | 55 | 41 | 26 | | | | | | | | | | | | | | | | | | | | |
| 586 | 837 | B1.0|REF97_V4|720 | 850 | B1.0|REF99_V4|11157 | 43 | 47 | 30 | 16 | | | | | | | | | | | | | | | | | | | | |
| 587 | 837 | B1.0|REF97_V4|720 | 892 | B1.0|REF99_V4|1177 | 43 | 21 | 20 | 7 | | | | | | | | | | | | | | | | | | | | |
| 588 | 837 | B1.0|REF97_V4|720 | 839 | B1.0|REF99_V4|1186 | 43 | 30 | 25 | 10 | | | | | | | | | | | | | | | | | | | | |
| 589 | 837 | B1.0|REF97_V4|720 | 121 | B1.0|REF99_V4|1211 | 43 | 46 | 29 | 16 | | | | | | | | | | | | | | | | | | | | |
| 590 | 837 | B1.0|REF97_V4|720 | 886 | B1.0|REF99_V4|1287 | 43 | 24 | 22 | 8 | | | | | | | | | | | | | | | | | | | | |
| 591 | 837 | B1.0|REF97_V4|720 | 939 | B1.0|REF99_V4|1317 | 43 | 32 | 25 | 11 | | | | | | | | | | | | | | | | | | | | |
| 592 | 837 | B1.0|REF97_V4|720 | 648 | B1.0|REF99_V4|114 | 43 | 78 | 41 | 26 | | | | | | | | | | | | | | | | | | | | |
| 593 | 837 | B1.0|REF97_V4|720 | 814 | B1.0|REF99_V4|1673 | 43 | 25 | 25 | 9 | | | | | | | | | | | | | | | | | | | | |
| 594 | 837 | B1.0|REF97_V4|720 | 684 | B1.0|REF99_V4|172 | 43 | 75 | 42 | 25 | | | | | | | | | | | | | | | | | | | | |
| 595 | 837 | B1.0|REF97_V4|720 | 313 | B1.0|REF99_V4|18024 | 43 | 21 | 20 | 7 | | | | | | | | | | | | | | | | | | | | |
| 596 | 837 | B1.0|REF97_V4|720 | 681 | B1.0|REF99_V4|234 | 43 | 46 | 30 | 16 | | | | | | | | | | | | | | | | | | | | |
| 597 | 837 | B1.0|REF97_V4|720 | 131 | B1.0|REF99_V4|251 | 43 | 33 | 27 | 11 | | | | | | | | | | | | | | | | | | | | |
| 598 | 837 | B1.0|REF97_V4|720 | 845 | B1.0|REF99_V4|2959 | 43 | 25 | 24 | 9 | | | | | | | | | | | | | | | | | | | | |
| 599 | 837 | B1.0|REF97_V4|720 | 961 | B1.0|REF99_V4|3580 | 43 | 21 | 20 | 7 | | | | | | | | | | | | | | | | | | | | |
| 600 | 837 | B1.0|REF97_V4|720 | 719 | B1.0|REF99_V4|385 | 43 | 52 | 32 | 18 | | | | | | | | | | | | | | | | | | | | |
| 601 | 837 | B1.0|REF97_V4|720 | 945 | B1.0|REF99_V4|442 | 43 | 46 | 29 | 9 | | | | | | | | | | | | | | | | | | | | |
| 602 | 837 | B1.0|REF97_V4|720 | 60 | B1.0|REF99_V4|4514 | 43 | 27 | 25 | 8 | | | | | | | | | | | | | | | | | | | | |
| 603 | 837 | B1.0|REF97_V4|720 | 818 | B1.0|REF99_V4|531 | 43 | 38 | 30 | 13 | | | | | | | | | | | | | | | | | | | | |
| 604 | 837 | B1.0|REF97_V4|720 | 734 | B1.0|REF99_V4|558 | 43 | 32 | 24 | 11 | | | | | | | | | | | | | | | | | | | | |
| 605 | 837 | B1.0|REF97_V4|720 | 775 | B1.0|REF99_V4|635 | 43 | 21 | 20 | 7 | | | | | | | | | | | | | | | | | | | | |
| 606 | 837 | B1.0|REF97_V4|720 | 319 | B1.0|REF99_V4|70731 | 43 | 24 | 24 | 8 | 23 | 31 | 19 | 8 | 36 | 53 | 28 | 12 | 22 | 18 | 15 | 11 | 35 | 53 | 28 | 15 | | | | |
| 607 | 510 | B1.0|REF97_V4|8981 | 1191 | B1.0|REF99_V4|150716 | 24 | 32 | 19 | 6 | | | | | | | | | | | | | | | | | | | | |
| 608 | 1007 | B1.0|REF97_V4|9526 | 892 | B1.0|REF99_V4|1177 | 31 | 21 | 18 | 5 | | | | | | | | | | | | | | | | | | | | |

TABLE 12-continued

| PAIR | B Endophyte 1 (SEQ ID NO:) | C Endophyte 1 (OTU) | D Endophyte 2 (SEQ ID NO:) | E Endophyte 2 (OTU) | F Bacteria - cultivated | | | | G Bacteria - cultivated, roots | | | | H Bacteria - cultivated, seeds | | | | I Bacteria - wild | | | | J Bacteria - wild, roots | | | | K Bacteria - wild, seeds | | | |
|---|---|---|---|---|---|---|---|---|---|---|---|---|---|---|---|---|---|---|---|---|---|---|---|---|---|---|---|---|
| | | | | | N1 | N2 | OC | EC | N1 | N2 | OC | EC | N1 | N2 | OC | EC | N1 | N2 | OC | EC | N1 | N2 | OC | EC | N1 | N2 | OC | EC |
| 609 | 1007 | B1.0|REF97_V49526 | 116 | B1.0|REF99_V41567 | 31 | 35 | 23 | 9 | | | | | | | | | | | | | | | | | | | | |
| 610 | 1007 | B1.0|REF97_V49526 | 810 | B1.0|REF99_V4250 | 31 | 39 | 27 | 10 | | | | | | | | | | | | | | | | | | | | |
| 611 | 1007 | B1.0|REF97_V49526 | 131 | B1.0|REF99_V4251 | 31 | 33 | 23 | 8 | | | | | | | | | | | | | | | | | | | | |
| 612 | 1007 | B1.0|REF97_V49526 | 963 | B1.0|REF99_V433855 | 31 | 27 | 22 | 7 | | | | | | | | | | | | | | | | | | | | |
| 613 | 1007 | B1.0|REF97_V49526 | 945 | B1.0|REF99_V4442 | 31 | 21 | 21 | 7 | | | | | | | | | | | | | | | | | | | | |
| 614 | 1007 | B1.0|REF97_V49526 | 880 | B1.0|REF99_V4472 | 31 | 27 | 22 | 8 | | | | | | | | | | | | | | | | | | | | |
| 615 | 1007 | B1.0|REF97_V49526 | 713 | B1.0|REF99_V4754 | 31 | 36 | 22 | 9 | | | | | | | | | | | | | | | | | | | | |
| 616 | 962 | B1.0|REF99_V4102519 | 71 | B1.0|REF99_V41351 | 19 | 38 | 19 | 6 | | | | | | | | | | | | | | | | | | | | |
| 617 | 962 | B1.0|REF99_V4102519 | 974 | B1.0|REF99_V42831 | 19 | 42 | 19 | 6 | | | | | | | | | | | | | | | | | | | | |
| 618 | 962 | B1.0|REF99_V4102519 | 916 | B1.0|REF99_V43675 | 19 | 40 | 19 | 6 | | | | | | | | | | | | | | | | | | | | |
| 619 | 137 | B1.0|REF99_V411 | 886 | B1.0|REF99_V41287 | 53 | 24 | 24 | 10 | | | | | | | | | | | | | | | | | | | | |
| 620 | 137 | B1.0|REF99_V411 | 648 | B1.0|REF99_V414 | 53 | 78 | 46 | 33 | | | | | | | | | | | | | | | | | | | | |
| 621 | 137 | B1.0|REF99_V411 | 814 | B1.0|REF99_V41673 | 53 | 75 | 24 | 10 | | | | | | | | | | | | | | | | | | | | |
| 622 | 137 | B1.0|REF99_V411 | 684 | B1.0|REF99_V4172 | 53 | 22 | 46 | 31 | | | | | | | | | | | | | | | | | | | | |
| 623 | 137 | B1.0|REF99_V411 | 613 | B1.0|REF99_V42200 | 53 | 22 | 22 | 9 | | | | | | | | | | | | | | | | | | | | |
| 624 | 137 | B1.0|REF99_V411 | 131 | B1.0|REF99_V4251 | 53 | 33 | 30 | 14 | | | | | | | | | | | | | | | | | | | | |
| 625 | 137 | B1.0|REF99_V411 | 845 | B1.0|REF99_V42959 | 53 | 25 | 24 | 10 | | | | | | | | | | | | | | | | | | | | |
| 626 | 137 | B1.0|REF99_V411 | 945 | B1.0|REF99_V4442 | 53 | 27 | 26 | 11 | | | | | | | | | | | | | | | | | | | | |
| 627 | 137 | B1.0|REF99_V411 | 60 | B1.0|REF99_V4514 | 53 | 23 | 23 | 10 | | | | | | | | | | | | | | | | | | | | |
| 628 | 137 | B1.0|REF99_V411 | 734 | B1.0|REF99_V4558 | 53 | 32 | 29 | 13 | | | | | | | | | | | | | | | | | | | | |
| 629 | 137 | B1.0|REF99_V411 | 319 | B1.0|REF99_V470731 | 53 | 24 | 24 | 10 | | | | | | | | | | | | | | | | | | | | |
| 630 | 850 | B1.0|REF99_V411157 | 839 | B1.0|REF99_V41186 | 47 | 30 | 24 | 11 | | | | | | | | | | | | | | | | | | | | |
| 631 | 850 | B1.0|REF99_V411157 | 121 | B1.0|REF99_V41211 | 47 | 46 | 32 | 17 | | | | | | | | | | | | | | | | | 39 | 52 | 29 | 17 |
| 632 | 850 | B1.0|REF99_V411157 | 681 | B1.0|REF99_V4234 | 47 | 46 | 33 | 17 | | | | | | | | | | | | | | | | | | | | |
| 633 | 850 | B1.0|REF99_V411157 | 719 | B1.0|REF99_V4385 | 47 | 52 | 35 | 19 | | | | | | | | | | | | | | | | | | | | |
| 634 | 850 | B1.0|REF99_V411157 | 818 | B1.0|REF99_V4531 | 47 | 38 | 27 | 14 | | | | | | | | | | | | | | | | | | | | |
| 635 | 850 | B1.0|REF99_V411157 | 430 | B1.0|REF99_V4659 | 47 | 32 | 27 | 12 | | | | | 20 | 13 | 12 | 3 | | | | | | | | | | | | |
| 636 | 850 | B1.0|REF99_V411157 | 837 | B1.0|REF99_V4720 | 47 | 55 | 36 | 20 | | | | | | | | | | | | | | | | | | | | |
| 637 | 884 | B1.0|REF99_V411164 | 892 | B1.0|REF99_V411177 | 30 | 21 | 18 | 5 | | | | | | | | | | | | | | | | | | | | |
| 638 | 884 | B1.0|REF99_V411164 | 886 | B1.0|REF99_V41287 | 30 | 24 | 20 | 6 | | | | | | | | | | | | | | | | | | | | |
| 639 | 884 | B1.0|REF99_V411164 | 939 | B1.0|REF99_V41317 | 30 | 32 | 21 | 8 | | | | | | | | | | | | | 24 | 19 | 16 | 12 | | | | |
| 640 | 884 | B1.0|REF99_V411164 | 116 | B1.0|REF99_V41567 | 30 | 35 | 22 | 8 | | | | | | | | | | | | | | | | | | | | |
| 641 | 884 | B1.0|REF99_V411164 | 963 | B1.0|REF99_V433855 | 30 | 22 | 18 | 5 | | | | | | | | | | | | | | | | | | | | |
| 642 | 884 | B1.0|REF99_V411164 | 945 | B1.0|REF99_V4442 | 30 | 33 | 22 | 8 | | | | | | | | | | | | | | | | | | | | |
| 643 | 884 | B1.0|REF99_V411164 | 880 | B1.0|REF99_V4472 | 30 | 27 | 23 | 6 | | | | | | | | | | | | | | | | | | | | |
| 644 | 884 | B1.0|REF99_V411164 | 131 | B1.0|REF99_V4251 | 30 | 31 | 25 | 7 | | | | | | | | | | | | | | | | | | | | |
| 645 | 884 | B1.0|REF99_V411164 | 683 | B1.0|REF99_V42385 | 30 | 22 | 18 | 5 | | | | | | | | | | | | | | | | | | | | |
| 646 | 884 | B1.0|REF99_V411164 | 319 | B1.0|REF99_V470731 | 30 | 24 | 19 | 6 | | | | | | | | | | | | | | | | | | | | |
| 647 | 884 | B1.0|REF99_V411164 | 713 | B1.0|REF99_V4754 | 30 | 36 | 23 | 9 | | | | | | | | | | | | | | | | | | | | |
| 648 | 884 | B1.0|REF99_V411164 | 959 | B1.0|REF99_V4126 | 21 | 37 | 19 | 6 | | | | | | | | | | | | | | | | | | | | |
| 649 | 892 | B1.0|REF99_V411177 | 1011 | B1.0|REF99_V42104 | 21 | 30 | 18 | 5 | | | | | | | | | | | | | | | | | | | | |
| 650 | 892 | B1.0|REF99_V411177 | 789 | B1.0|REF99_V42172 | 21 | 42 | 21 | 7 | | | | | | | | | | | | | | | | | | | | |
| 651 | 892 | B1.0|REF99_V411177 | 943 | B1.0|REF99_V426030 | 21 | 31 | 20 | 5 | 21 | 31 | 20 | 15.5 | | | | | | | | | | | | | | | | |
| 652 | 892 | B1.0|REF99_V411177 | 974 | B1.0|REF99_V42831 | 21 | 42 | 21 | 7 | | | | | | | | | | | | | | | | | | | | |
| 653 | 892 | B1.0|REF99_V411177 | 916 | B1.0|REF99_V43675 | 21 | 40 | 21 | 7 | | | | | | | | | | | | | | | | | | | | |
| 654 | 892 | B1.0|REF99_V411177 | 1007 | B1.0|REF99_V49526 | 21 | 42 | 20 | 7 | | | | | | | | | | | | | | | | | | | | |

TABLE 12-continued

| A PAIR | B Endophyte 1 (SEQ ID NO:) | C Endophyte 1 (OTU) | D Endophyte 2 (SEQ ID NO:) | E Endophyte 2 (OTU) | F Bacteria - cultivated | | | | G Bacteria - cultivated, roots | | | | H Bacteria - cultivated, seeds | | | | I Bacteria - wild | | | | J Bacteria - wild, roots | | | | K Bacteria - wild, seeds | | | |
|---|---|---|---|---|---|---|---|---|---|---|---|---|---|---|---|---|---|---|---|---|---|---|---|---|---|---|---|---|
| | | | | | N1 | N2 | OC | EC | N1 | N2 | OC | EC | N1 | N2 | OC | EC | N1 | N2 | OC | EC | N1 | N2 | OC | EC | N1 | N2 | OC | EC |
| 655 | 54 | B1.0|REF99_V4|118524 | 959 | B1.0|REF99_V4|126 | 22 | 37 | 21 | 6 | | | | | | | | | | | | | | | | | | | | |
| 656 | 54 | B1.0|REF99_V4|118524 | 71 | B1.0|REF99_V4|1351 | 22 | 38 | 20 | 7 | | | | | | | | | | | | | | | | | | | | |
| 657 | 54 | B1.0|REF99_V4|118524 | 789 | B1.0|REF99_V4|2172 | 22 | 42 | 20 | 7 | | | | | | | | | | | | | | | | | | | | |
| 658 | 54 | B1.0|REF99_V4|118524 | 810 | B1.0|REF99_V4|2172 | 22 | 39 | 22 | 7 | | | | | | | | | | | | | | | | | | | | |
| 659 | 54 | B1.0|REF99_V4|118524 | 974 | B1.0|REF99_V4|2831 | 22 | 42 | 22 | 7 | | | | | | | | | | | | | | | | | | | | |
| 660 | 54 | B1.0|REF99_V4|118524 | 916 | B1.0|REF99_V4|3675 | 22 | 40 | 21 | 7 | | | | | | | | | | | | | | | | | | | | |
| 661 | 54 | B1.0|REF99_V4|118524 | 1012 | B1.0|REF99_V4|597 | 22 | 39 | 20 | 6 | | | | | | | | | | | | | | | | | | | | |
| 662 | 54 | B1.0|REF99_V4|118524 | 713 | B1.0|REF99_V4|754 | 22 | 36 | 19 | 7 | | | | | | | | | | | | | | | | | | | | |
| 663 | 54 | B1.0|REF99_V4|118524 | 1007 | B1.0|REF99_V4|9526 | 22 | 42 | 20 | 6 | | | | | | | | | | | | | | | | | | | | |
| 664 | 54 | B1.0|REF99_V4|118524 | 959 | B1.0|REF99_V4|126 | 30 | 37 | 23 | 9 | | | | | | | | | | | | | | | | | | | | |
| 665 | 839 | B1.0|REF99_V4|1186 | 71 | B1.0|REF99_V4|1351 | 30 | 38 | 22 | 9 | | | | | | | | | | | | | | | | | | | | |
| 666 | 839 | B1.0|REF99_V4|1186 | 810 | B1.0|REF99_V4|250 | 30 | 39 | 23 | 9 | | | | | | | | | | | | | | | | | | | | |
| 667 | 839 | B1.0|REF99_V4|1186 | 1221 | B1.0|REF99_V4|2512 | 30 | 31 | 21 | 7 | 24 | 22 | 17 | 12.6 | | | | | | | | | | | | | | | | |
| 668 | 839 | B1.0|REF99_V4|1186 | 974 | B1.0|REF99_V4|2831 | 30 | 42 | 24 | 10 | | | | | | | | | | | | | | | | | | | | |
| 669 | 839 | B1.0|REF99_V4|1186 | 1012 | B1.0|REF99_V4|597 | 30 | 39 | 23 | 9 | | | | | | | | | | | | | | | | | | | | |
| 670 | 839 | B1.0|REF99_V4|1186 | 837 | B1.0|REF99_V4|720 | 30 | 55 | 28 | 13 | | | | | | | | | | | | | | | | | | | | |
| 671 | 121 | B1.0|REF99_V4|1211 | 1184 | B1.0|REF99_V4|20510 | 46 | 34 | 27 | 12 | 25 | 22 | 18 | 13.1 | | | | | | | | | | | | | | | | |
| 672 | 121 | B1.0|REF99_V4|1211 | 681 | B1.0|REF99_V4|234 | 46 | 30 | 30 | 17 | 25 | 19 | 18 | 11.3 | | | | | | | | | | | | | | | | |
| 673 | 121 | B1.0|REF99_V4|1211 | 430 | B1.0|REF99_V4|659 | 46 | 32 | 30 | 12 | | | | | | | | | | | | | | | | | | | | |
| 674 | 121 | B1.0|REF99_V4|1211 | 837 | B1.0|REF99_V4|720 | 46 | 55 | 36 | 20 | | | | | | | | | | | | | | | | | | | | |
| 675 | 1104 | B1.0|REF99_V4|22519 | 1091 | B1.0|REF99_V4|415 | 22 | 30 | 18 | 5 | | | | | 21 | 13 | 12 | 3 | | | | | | | | | | | | |
| 676 | 1104 | B1.0|REF99_V4|22519 | 1092 | B1.0|REF99_V4|476 | 22 | 34 | 19 | 6 | | | | | | | | | | | | | | | | | | | | |
| 677 | 706 | B1.0|REF99_V4|12451 | 681 | B1.0|REF99_V4|234 | 31 | 46 | 25 | 11 | | | | | 22 | 26 | 18 | 7 | | | | | | | | | | | | |
| 678 | 959 | B1.0|REF99_V4|126 | 886 | B1.0|REF99_V4|1287 | 37 | 24 | 22 | 7 | | | | | 22 | 26 | 19 | 7 | | | | | | | | | | | | |
| 679 | 959 | B1.0|REF99_V4|126 | 939 | B1.0|REF99_V4|1317 | 37 | 32 | 24 | 9 | | | | | | | | | | | | | | | | | | | | |
| 680 | 959 | B1.0|REF99_V4|126 | 1013 | B1.0|REF99_V4|13951 | 37 | 21 | 20 | 6 | | | | | | | | | | | | | | | | | | | | |
| 681 | 959 | B1.0|REF99_V4|126 | 814 | B1.0|REF99_V4|1673 | 37 | 25 | 24 | 7 | | | | | | | | | | | | | | | | | | | | |
| 682 | 959 | B1.0|REF99_V4|126 | 59 | B1.0|REF99_V4|171149 | 37 | 75 | 36 | 22 | | | | | | | | | | | | | 18 | 20 | 15 | 10 | | | | |
| 683 | 959 | B1.0|REF99_V4|126 | 684 | B1.0|REF99_V4|172 | 37 | 21 | 19 | 6 | | | | | | | | | | | | | | | | | | | | |
| 684 | 959 | B1.0|REF99_V4|126 | 313 | B1.0|REF99_V4|18024 | 37 | 21 | 20 | 6 | | | | | | | | | | | | | | | | | | | | |
| 685 | 959 | B1.0|REF99_V4|126 | 613 | B1.0|REF99_V4|2200 | 37 | 22 | 21 | 6 | | | | | | | | | | | | | | | | | | | | |
| 686 | 959 | B1.0|REF99_V4|126 | 681 | B1.0|REF99_V4|234 | 37 | 46 | 29 | 13 | | | | | | | | | | | | | | | | | | | | |
| 687 | 959 | B1.0|REF99_V4|126 | 683 | B1.0|REF99_V4|2385 | 37 | 22 | 21 | 6 | | | | | | | | | | | | | | | | | | | | |
| 688 | 959 | B1.0|REF99_V4|126 | 845 | B1.0|REF99_V4|2959 | 37 | 25 | 24 | 7 | | | | | | | | | | | | | | | | | | | | |
| 689 | 959 | B1.0|REF99_V4|126 | 719 | B1.0|REF99_V4|385 | 37 | 52 | 28 | 15 | | | | | | | | | | | | | | | | | | | | |
| 690 | 959 | B1.0|REF99_V4|126 | 60 | B1.0|REF99_V4|4514 | 37 | 23 | 21 | 7 | | | | | | | | | | | | | | | | | | | | |
| 691 | 959 | B1.0|REF99_V4|126 | 818 | B1.0|REF99_V4|531 | 37 | 38 | 25 | 11 | | | | | | | | | | | | | | | | | | | | |
| 692 | 959 | B1.0|REF99_V4|126 | 734 | B1.0|REF99_V4|558 | 37 | 32 | 25 | 9 | | | | | | | | | | | | | | | | | | | | |
| 693 | 959 | B1.0|REF99_V4|126 | 319 | B1.0|REF99_V4|70731 | 37 | 24 | 22 | 6 | | | | | | | | | | | | | | | | | | | | |
| 694 | 886 | B1.0|REF99_V4|1287 | 71 | B1.0|REF99_V4|1351 | 24 | 38 | 22 | 8 | | | | | | | | | | | | | | | | | | | | |
| 695 | 886 | B1.0|REF99_V4|1287 | 1011 | B1.0|REF99_V4|2104 | 24 | 30 | 19 | 6 | | | | | | | | | | | | | | | | | | | | |
| 696 | 886 | B1.0|REF99_V4|1287 | 789 | B1.0|REF99_V4|2172 | 24 | 42 | 24 | 8 | | | | | | | | | | | | | | | | | | | | |
| 697 | 886 | B1.0|REF99_V4|1287 | 810 | B1.0|REF99_V4|250 | 24 | 39 | 21 | 7 | | | | | | | | | | | | | | | | | | | | |
| 698 | 886 | B1.0|REF99_V4|1287 | 943 | B1.0|REF99_V4|26030 | 24 | 31 | 22 | 6 | | | | | | | | | | | | | | | | | | | | |
| 699 | 886 | B1.0|REF99_V4|1287 | 615 | B1.0|REF99_V4|3374 | 24 | 34 | 21 | 6 | 24 | 31 | 22 | 17.7 | | | | | | | | | | | | | | | | |
| 700 | 886 | B1.0|REF99_V4|1287 | 945 | B1.0|REF99_V4|4442 | 24 | 27 | 19 | 5 | | | | | | | | | | | | | | | | | | | | |

TABLE 12-continued

| A PAIR | B Endophyte 1 (SEQ ID NO:) | C Endophyte 1 (OTU) | D Endophyte 2 (SEQ ID NO:) | E Endophyte 2 (OTU) | F Bacteria - cultivated | | | | G Bacteria - cultivated, roots | | | | H Bacteria - cultivated, seeds | | | | I Bacteria - wild | | | | J Bacteria - wild, roots | | | | K Bacteria - wild, seeds | | | |
|---|---|---|---|---|---|---|---|---|---|---|---|---|---|---|---|---|---|---|---|---|---|---|---|---|---|---|---|---|
| | | | | | N1 | N2 | OC | EC | N1 | N2 | OC | EC | N1 | N2 | OC | EC | N1 | N2 | OC | EC | N1 | N2 | OC | EC | N1 | N2 | OC | EC |
| 701 | 886 | B1.0|REF99_V4|1287 | 880 | B1.0|REF99_V4|1472 | 24 | 31 | 19 | 6 | | | | | | | | | | | | | | | | | | | | |
| 702 | 886 | B1.0|REF99_V4|1287 | 1012 | B1.0|REF99_V4|597 | 24 | 39 | 21 | 7 | | | | | | | | | | | | | | | | | | | | |
| 703 | 886 | B1.0|REF99_V4|1287 | 319 | B1.0|REF99_V4|70731 | 24 | 24 | 18 | 5 | 24 | 24 | 18 | 13.7 | | | | | | | | | | | | | | | |
| 704 | 886 | B1.0|REF99_V4|1287 | 837 | B1.0|REF99_V4|754 | 24 | 55 | 24 | 10 | | | | | | | | | | | | | | | | | | | |
| 705 | 886 | B1.0|REF99_V4|1287 | 713 | B1.0|REF99_V4|720 | 24 | 36 | 20 | 7 | | | | | | | | | | | | | | | | | | | |
| 706 | 886 | B1.0|REF99_V4|1287 | 1007 | B1.0|REF99_V4|9526 | 24 | 42 | 22 | 8 | | | | | | | | | | | | | | | | | | | |
| 707 | 939 | B1.0|REF99_V4|1317 | 71 | B1.0|REF99_V4|1351 | 32 | 38 | 24 | 10 | | | | | | | | | | | | | | | | | | | |
| 708 | 939 | B1.0|REF99_V4|1317 | 789 | B1.0|REF99_V4|2172 | 32 | 42 | 26 | 11 | | | | | | | | | | | | | | | | | | | |
| 709 | 939 | B1.0|REF99_V4|1317 | 683 | B1.0|REF99_V4|2385 | 32 | 22 | 19 | 6 | 26 | 22 | 19 | 13.6 | | | | | | | | | | | | | | | |
| 710 | 939 | B1.0|REF99_V4|1317 | 810 | B1.0|REF99_V4|250 | 32 | 39 | 24 | 10 | | | | | | | | | | | | | | | | | | | |
| 711 | 939 | B1.0|REF99_V4|1317 | 974 | B1.0|REF99_V4|2831 | 32 | 42 | 26 | 11 | | | | | | | | | | | | | | | | | | | |
| 712 | 939 | B1.0|REF99_V4|1317 | 615 | B1.0|REF99_V4|3374 | 32 | 34 | 24 | 9 | | | | | | | | | | | | | | | | | | | |
| 713 | 939 | B1.0|REF99_V4|1317 | 916 | B1.0|REF99_V4|3675 | 32 | 40 | 24 | 10 | | | | | | | | | | | | | | | | | | | |
| 714 | 939 | B1.0|REF99_V4|1317 | 945 | B1.0|REF99_V4|442 | 32 | 27 | 20 | 7 | | | | | | | | | | | | | | | | | | | |
| 715 | 939 | B1.0|REF99_V4|1317 | 837 | B1.0|REF99_V4|720 | 32 | 55 | 28 | 14 | | | | | | | | | | | | | | | | | | | |
| 716 | 939 | B1.0|REF99_V4|1317 | 648 | B1.0|REF99_V4|414 | 32 | 78 | 36 | 23 | | | | | | | | | | | | | | | | | | | |
| 717 | 71 | B1.0|REF99_V4|1351 | 814 | B1.0|REF99_V4|558 | 38 | 25 | 21 | 8 | | | | | | | | | | | | | | | | | | | |
| 718 | 71 | B1.0|REF99_V4|1351 | 59 | B1.0|REF99_V4|171149 | 38 | 21 | 19 | 6 | | | | | | | | | | | | | | | | | | | |
| 719 | 71 | B1.0|REF99_V4|1351 | 684 | B1.0|REF99_V4|172 | 38 | 75 | 36 | 22 | | | | | | | | | | | | | | | | | | | |
| 720 | 71 | B1.0|REF99_V4|1351 | 313 | B1.0|REF99_V4|18024 | 38 | 21 | 21 | 6 | | | | | | | | | | | | | | | | | | | |
| 721 | 71 | B1.0|REF99_V4|1351 | 656 | B1.0|REF99_V4|191 | 38 | 34 | 24 | 10 | | | | | | | | | | | | | | | | | | | |
| 722 | 71 | B1.0|REF99_V4|1351 | 613 | B1.0|REF99_V4|2200 | 38 | 22 | 20 | 7 | | | | | | | | | | | | | | | | | | | |
| 723 | 71 | B1.0|REF99_V4|1351 | 681 | B1.0|REF99_V4|234 | 38 | 46 | 28 | 14 | | | | | | | | | | | | | | | | | | | |
| 724 | 71 | B1.0|REF99_V4|1351 | 683 | B1.0|REF99_V4|2385 | 38 | 22 | 20 | 7 | | | | | | | | | | | | | | | | | | | |
| 725 | 71 | B1.0|REF99_V4|1351 | 845 | B1.0|REF99_V4|2959 | 38 | 25 | 21 | 8 | | | | | | | | | | | | | | | | | | | |
| 726 | 71 | B1.0|REF99_V4|1351 | 961 | B1.0|REF99_V4|3580 | 38 | 21 | 19 | 6 | | | | | | | | | | | | | | | | | | | |
| 727 | 71 | B1.0|REF99_V4|1351 | 719 | B1.0|REF99_V4|385 | 38 | 52 | 29 | 16 | | | | | | | | | | | | | | | | | | | |
| 728 | 71 | B1.0|REF99_V4|1351 | 945 | B1.0|REF99_V4|442 | 38 | 22 | 22 | 8 | | | | | | | | | | | | | | | | | | | |
| 729 | 71 | B1.0|REF99_V4|1351 | 734 | B1.0|REF99_V4|558 | 38 | 32 | 23 | 10 | | | | | | | | | | | | | | | | | | | |
| 730 | 71 | B1.0|REF99_V4|1351 | 319 | B1.0|REF99_V4|70731 | 38 | 24 | 22 | 7 | | | | | | | | | 32 | 42 | 25 | 8 | | | | | | | | |
| 731 | 1013 | B1.0|REF99_V4|13951 | 789 | B1.0|REF99_V4|2172 | 21 | 42 | 20 | 7 | | | | | | | | | | | | | | | | | | | | |
| 732 | 1013 | B1.0|REF99_V4|13951 | 810 | B1.0|REF99_V4|250 | 21 | 39 | 20 | 6 | | | | | | | | | | | | | | | | | | | |
| 733 | 1013 | B1.0|REF99_V4|13951 | 974 | B1.0|REF99_V4|2831 | 21 | 42 | 21 | 7 | | | | | | | | | | | | | | | | | | | |
| 734 | 1013 | B1.0|REF99_V4|13951 | 916 | B1.0|REF99_V4|3675 | 21 | 40 | 20 | 7 | | | | | | | | | | | | | | | | | | | |
| 735 | 648 | B1.0|REF99_V4|414 | 789 | B1.0|REF99_V4|2172 | 78 | 42 | 41 | 26 | | | | | | | | | | | | | | | | | | | |
| 736 | 648 | B1.0|REF99_V4|414 | 810 | B1.0|REF99_V4|250 | 78 | 39 | 39 | 24 | | | | | | | | | | | | | | | | | | | |
| 737 | 648 | B1.0|REF99_V4|414 | 615 | B1.0|REF99_V4|3374 | 78 | 34 | 34 | 21 | | | | | | | | | | | | | | | | | | | |
| 738 | 1112 | B1.0|REF99_V4|14460 | 1086 | B1.0|REF99_V4|25794 | 40 | 26 | 21 | 8 | | | | | 40 | 26 | 21 | 12 | | | | | | | | | | | | |
| 739 | 1091 | B1.0|REF99_V4|415 | 1092 | B1.0|REF99_V4|476 | 30 | 34 | 22 | 8 | | | | | 26 | 26 | 20 | 8 | | | | | | | | | 46 | 38 | 27 | 14 |
| 740 | 116 | B1.0|REF99_V4|1567 | 1171 | B1.0|REF99_V4|11639 | 35 | 21 | 19 | 6 | | | | | | | | | | | | | | | | | | | | |
| 741 | 116 | B1.0|REF99_V4|1567 | 814 | B1.0|REF99_V4|11673 | 35 | 25 | 22 | 7 | | | | | | | | | | | | | | | | | | | |
| 742 | 116 | B1.0|REF99_V4|1567 | 131 | B1.0|REF99_V4|1251 | 35 | 33 | 23 | 9 | | | | | | | | | | | | | | | | | | | |
| 743 | 116 | B1.0|REF99_V4|1567 | 845 | B1.0|REF99_V4|2959 | 35 | 25 | 23 | 8 | | | | | | | | | | | | | | | | | | | |
| 744 | 116 | B1.0|REF99_V4|1567 | 719 | B1.0|REF99_V4|385 | 35 | 52 | 27 | 14 | | | | | | | | | | | | | | | | | | | |
| 745 | 116 | B1.0|REF99_V4|1567 | 945 | B1.0|REF99_V4|442 | 35 | 27 | 21 | 7 | | | | | | | | | | | | | | | | | | | |
| 746 | 1171 | B1.0|REF99_V4|1639 | 789 | B1.0|REF99_V4|2172 | 21 | 42 | 21 | 7 | | | | | | | | | | | | | | | | | | | |

TABLE 12-continued

| A | B | C | D | E | F Bacteria - cultivated | | | | G Bacteria - cultivated, roots | | | | H Bacteria - cultivated, seeds | | | | I Bacteria - wild | | | | J Bacteria - wild, roots | | | | K Bacteria - wild, seeds | | | |
|---|---|---|---|---|---|---|---|---|---|---|---|---|---|---|---|---|---|---|---|---|---|---|---|---|---|---|---|---|
| PAIR | Endophyte 1 (SEQ ID NO:) | Endophyte 1 (OTU) | Endophyte 2 (SEQ ID NO:) | Endophyte 2 (OTU) | N1 | N2 | OC | EC | N1 | N2 | OC | EC | N1 | N2 | OC | EC | N1 | N2 | OC | EC | N1 | N2 | OC | EC | N1 | N2 | OC | EC |
| 747 | 1171 | B1.0|REF99_V4|1639 | 810 | B1.0|REF99_V4|250 | 21 | 39 | 20 | 6 | | | | | | | | | | | | | | | | | | | | |
| 748 | 1171 | B1.0|REF99_V4|1639 | 1012 | B1.0|REF99_V4|597 | 21 | 39 | 20 | 6 | | | | | | | | | | | | | | | | | | | | |
| 749 | 1180 | B1.0|REF99_V4|166 | 789 | B1.0|REF99_V4|2172 | 46 | 42 | 29 | 15 | | | | | | | | | | | | | | | | | | | | |
| 750 | 814 | B1.0|REF99_V4|1673 | 789 | B1.0|REF99_V4|2172 | 25 | 39 | 24 | 8 | | | | | | | | | | | | | | | | | | | | |
| 751 | 814 | B1.0|REF99_V4|1673 | 810 | B1.0|REF99_V4|250 | 25 | 31 | 23 | 6 | | | | | | | | | | | | | | | | | | | | |
| 752 | 814 | B1.0|REF99_V4|1673 | 943 | B1.0|REF99_V4|26030 | 25 | 21 | 21 | 6 | | | | | | | | | | | | | | | | | | | | |
| 753 | 814 | B1.0|REF99_V4|1673 | 974 | B1.0|REF99_V4|2831 | 25 | 42 | 25 | 8 | | | | | | | | | | | | | | | | | | | | |
| 754 | 814 | B1.0|REF99_V4|1673 | 916 | B1.0|REF99_V4|3675 | 25 | 40 | 25 | 8 | | | | | | | | | | | | | | | | | | | | |
| 755 | 814 | B1.0|REF99_V4|1673 | 880 | B1.0|REF99_V4|472 | 25 | 31 | 20 | 6 | | | | | | | | | | | | | | | | | | | | |
| 756 | 814 | B1.0|REF99_V4|1673 | 1012 | B1.0|REF99_V4|597 | 25 | 39 | 24 | 8 | | | | | | | | | | | | | | | | | | | | |
| 757 | 814 | B1.0|REF99_V4|1673 | 837 | B1.0|REF99_V4|720 | 25 | 55 | 25 | 11 | | | | | | | | | | | | | | | | | | | | |
| 758 | 814 | B1.0|REF99_V4|1673 | 713 | B1.0|REF99_V4|754 | 25 | 36 | 20 | 7 | | | | | | | | | | | | | | | | | | | | |
| 759 | 814 | B1.0|REF99_V4|1673 | 1007 | B1.0|REF99_V4|9526 | 25 | 42 | 24 | 8 | | | | | | | | | | | | | | | | | | | | |
| 760 | 1088 | B1.0|REF99_V4|1703 | 972 | B1.0|REF99_V4|218 | 44 | 32 | 24 | 11 | | | | | | | | | | | | | | | | | | | | |
| 761 | 59 | B1.0|REF99_V4|171149 | 789 | B1.0|REF99_V4|2172 | 21 | 42 | 20 | 7 | | | | | | | | | | | | | | | | | | | | |
| 762 | 59 | B1.0|REF99_V4|171149 | 974 | B1.0|REF99_V4|2831 | 21 | 42 | 21 | 7 | | | | | | | | | | | | | | | | | | | | |
| 763 | 59 | B1.0|REF99_V4|171149 | 916 | B1.0|REF99_V4|3675 | 21 | 40 | 20 | 7 | | | | | | | | | | | | | | | | | | | | |
| 764 | 684 | B1.0|REF99_V4|172 | 789 | B1.0|REF99_V4|2172 | 75 | 39 | 39 | 25 | | | | | | | | | | | | | | | | | | | | |
| 765 | 684 | B1.0|REF99_V4|172 | 681 | B1.0|REF99_V4|234 | 75 | 46 | 42 | 27 | | | | | | | | | | | | | | | | | | | | |
| 766 | 684 | B1.0|REF99_V4|172 | 810 | B1.0|REF99_V4|250 | 75 | 39 | 39 | 23 | | | | | | | | | | | | | | | | | | | | |
| 767 | 684 | B1.0|REF99_V4|172 | 974 | B1.0|REF99_V4|2831 | 75 | 42 | 41 | 25 | | | | | | | | | | | | | | | | | | | | |
| 768 | 684 | B1.0|REF99_V4|172 | 615 | B1.0|REF99_V4|3374 | 75 | 34 | 33 | 20 | | | | | | | | | | | | | | | | | | | | |
| 769 | 684 | B1.0|REF99_V4|172 | 916 | B1.0|REF99_V4|3675 | 75 | 40 | 39 | 24 | | | | | | | | | | | | | | | | | | | | |
| 770 | 684 | B1.0|REF99_V4|172 | 880 | B1.0|REF99_V4|472 | 75 | 31 | 31 | 18 | | | | | | | | | | | | | | | | | | | | |
| 771 | 684 | B1.0|REF99_V4|172 | 1012 | B1.0|REF99_V4|597 | 75 | 39 | 39 | 23 | | | | | | | | | | | | | | | | | | | | |
| 772 | 684 | B1.0|REF99_V4|172 | 837 | B1.0|REF99_V4|720 | 75 | 55 | 49 | 33 | | | | | | | | | | | | | | | | | | | | |
| 773 | 684 | B1.0|REF99_V4|172 | 1007 | B1.0|REF99_V4|9526 | 75 | 42 | 39 | 25 | | | | | | | | | | | | | | | | | | | | |
| 774 | 313 | B1.0|REF99_V4|18024 | 789 | B1.0|REF99_V4|2172 | 21 | 42 | 20 | 7 | | | | | | | | | | | | | | | | | | | | |
| 775 | 313 | B1.0|REF99_V4|18024 | 974 | B1.0|REF99_V4|2831 | 21 | 42 | 21 | 7 | | | | | | | | | | | | | | | | | | | | |
| 776 | 313 | B1.0|REF99_V4|18024 | 615 | B1.0|REF99_V4|3374 | 21 | 34 | 19 | 6 | | | | | | | | | | | | | | | | | | | | |
| 777 | 313 | B1.0|REF99_V4|18024 | 713 | B1.0|REF99_V4|754 | 21 | 36 | 19 | 7 | | | | | | | | | | | | | | | | | | | | |
| 778 | 889 | B1.0|REF99_V4|185 | 1011 | B1.0|REF99_V4|2104 | 31 | 30 | 20 | 7 | | | | | | | | | 31 | 32 | 23 | 6 | | | | | | | | |
| 779 | 889 | B1.0|REF99_V4|185 | 810 | B1.0|REF99_V4|250 | 31 | 39 | 24 | 10 | | | | | | | | | | | | | | | | | | | | |
| 780 | 889 | B1.0|REF99_V4|185 | 615 | B1.0|REF99_V4|3374 | 31 | 34 | 22 | 8 | | | | | | | | | | | | | | | | | | | | |
| 781 | 889 | B1.0|REF99_V4|185 | 880 | B1.0|REF99_V4|472 | 31 | 31 | 21 | 8 | | | | | | | | | | | | | | | | | | | | |
| 782 | 889 | B1.0|REF99_V4|185 | 1007 | B1.0|REF99_V4|9526 | 31 | 42 | 23 | 10 | | | | | | | | | | | | | | | | | | | | |
| 783 | 656 | B1.0|REF99_V4|191 | 810 | B1.0|REF99_V4|250 | 34 | 39 | 25 | 10 | | | | | | | | | | | | | | | | | | | | |
| 784 | 656 | B1.0|REF99_V4|191 | 713 | B1.0|REF99_V4|754 | 34 | 36 | 22 | 9 | | | | | | | | | | | | | | | | | | | | |
| 785 | 656 | B1.0|REF99_V4|191 | 1011 | B1.0|REF99_V4|2104 | 34 | 30 | 20 | 7 | | | | | | | | | 42 | 30 | 24 | 8 | | | | | | | | |
| 786 | 1184 | B1.0|REF99_V4|20510 | 615 | B1.0|REF99_V4|3374 | 34 | 34 | 22 | 9 | | | | | | | | | | | | | | | | | | | | |
| 787 | 1011 | B1.0|REF99_V4|2104 | 837 | B1.0|REF99_V4|720 | 34 | 55 | 28 | 15 | | | | | | | | | | | | | | | | | | | | |
| 788 | 1011 | B1.0|REF99_V4|2104 | 681 | B1.0|REF99_V4|234 | 30 | 46 | 25 | 11 | | | | | | | | | | | | | | | | | | | | |
| 789 | 789 | B1.0|REF99_V4|2172 | 945 | B1.0|REF99_V4|4442 | 30 | 27 | 20 | 6 | | | | | | | | | | | | | | | | | | | | |
| 790 | 789 | B1.0|REF99_V4|2172 | 613 | B1.0|REF99_V4|2200 | 42 | 39 | 23 | 10 | | | | | | | | | | | | | | | | | | | | |
| 791 | 789 | B1.0|REF99_V4|2172 | 681 | B1.0|REF99_V4|234 | 42 | 46 | 30 | 15 | | | | | | | | | | | | | | | | | | | | |
| 792 | 789 | B1.0|REF99_V4|2172 | 845 | B1.0|REF99_V4|2959 | 42 | 25 | 22 | 8 | | | | | | | | | | | | | | | | | | | | |

TABLE 12-continued

| A | B | C | D | E | F Bacteria - cultivated | | | | G Bacteria - cultivated, roots | | | | H Bacteria - cultivated, seeds | | | | I Bacteria - wild | | | | J Bacteria - wild, roots | | | | K Bacteria - wild, seeds | | | |
|---|---|---|---|---|---|---|---|---|---|---|---|---|---|---|---|---|---|---|---|---|---|---|---|---|---|---|---|---|
| PAIR | Endophyte 1 (SEQ ID NO:) | Endophyte 1 (OTU) | Endophyte 2 (SEQ ID NO:) | Endophyte 2 (OTU) | N1 | N2 | OC | EC | N1 | N2 | OC | EC | N1 | N2 | OC | EC | N1 | N2 | OC | EC | N1 | N2 | OC | EC | N1 | N2 | OC | EC |
| 793 | 789 | B1.0\|REF99_V4\|2172 | 945 | B1.0\|REF99_V4\|4442 | 42 | 27 | 26 | 9 | | | | | | | | | | | | | | | | | | | | |
| 794 | 789 | B1.0\|REF99_V4\|2172 | 60 | B1.0\|REF99_V4\|4514 | 42 | 23 | 21 | 8 | | | | | | | | | | | | | | | | | | | | |
| 795 | 789 | B1.0\|REF99_V4\|2172 | 818 | B1.0\|REF99_V4\|4531 | 42 | 38 | 26 | 13 | | | | | | | | | | | | | | | | | | | | |
| 796 | 789 | B1.0\|REF99_V4\|2172 | 734 | B1.0\|REF99_V4\|4558 | 42 | 32 | 26 | 11 | | | | | | | | | | | | | | | | | | | | |
| 797 | 789 | B1.0\|REF99_V4\|2172 | 319 | B1.0\|REF99_V4\|70731 | 42 | 24 | 22 | 8 | | | | | | | | | | | | | | | | | | | | |
| 798 | 613 | B1.0\|REF99_V4\|2200 | 974 | B1.0\|REF99_V4\|2831 | 22 | 42 | 22 | 7 | | | | | | | | | | | | | | | | | | | | |
| 799 | 613 | B1.0\|REF99_V4\|2200 | 615 | B1.0\|REF99_V4\|3374 | 22 | 34 | 19 | 6 | | | | | | | | | | | | | | | | | | | | |
| 800 | 613 | B1.0\|REF99_V4\|2200 | 916 | B1.0\|REF99_V4\|3675 | 22 | 42 | 20 | 7 | | | | | | | | | | | | | | | | | | | | |
| 801 | 613 | B1.0\|REF99_V4\|2200 | 713 | B1.0\|REF99_V4\|4754 | 22 | 36 | 19 | 6 | | | | | | | | | | | | | | | | | | | | |
| 802 | 613 | B1.0\|REF99_V4\|2200 | 915 | B1.0\|REF99_V4\|4884 | 22 | 27 | 19 | 5 | 22 | 27 | 19 | 14.1 | | | | | | | | | | | | | | | | | |
| 803 | 613 | B1.0\|REF99_V4\|2200 | 1007 | B1.0\|REF99_V4\|49526 | 22 | 42 | 21 | 7 | | | | | | | | | | | | | | | | | | | | |
| 804 | 887 | B1.0\|REF99_V4\|2238 | 974 | B1.0\|REF99_V4\|2831 | 19 | 42 | 19 | 6 | | | | | | | | | | | | | | | | | | | | |
| 805 | 681 | B1.0\|REF99_V4\|234 | 810 | B1.0\|REF99_V4\|4250 | 46 | 39 | 27 | 14 | | | | | | | | | | | | | | | | | | | | |
| 806 | 681 | B1.0\|REF99_V4\|234 | 974 | B1.0\|REF99_V4\|2831 | 46 | 42 | 30 | 15 | | | | | | | | | | | | | | | | | | | | |
| 807 | 681 | B1.0\|REF99_V4\|234 | 916 | B1.0\|REF99_V4\|3675 | 46 | 40 | 29 | 15 | | | | | | | | | | | | | | | | | | | | |
| 808 | 681 | B1.0\|REF99_V4\|234 | 719 | B1.0\|REF99_V4\|4385 | 46 | 52 | 34 | 19 | | | | | | | | | | | | | | | | | | | | |
| 809 | 681 | B1.0\|REF99_V4\|234 | 818 | B1.0\|REF99_V4\|4531 | 46 | 38 | 27 | 14 | | | | | | | | | | | | | | | | | | | | |
| 810 | 681 | B1.0\|REF99_V4\|234 | 1012 | B1.0\|REF99_V4\|4597 | 46 | 39 | 27 | 14 | | | | | | | | | | | | | | | | | | | | |
| 811 | 681 | B1.0\|REF99_V4\|234 | 430 | B1.0\|REF99_V4\|4659 | 46 | 32 | 25 | 12 | | | | | | | | | | | | | | | | | | | | |
| 812 | 681 | B1.0\|REF99_V4\|234 | 1007 | B1.0\|REF99_V4\|49526 | 46 | 42 | 28 | 15 | | | | | | | | | | | | | | | | | | | | |
| 813 | 683 | B1.0\|REF99_V4\|2385 | 810 | B1.0\|REF99_V4\|4250 | 22 | 39 | 20 | 7 | | | | | | | | | | | | | | | | | | | | |
| 814 | 683 | B1.0\|REF99_V4\|2385 | 615 | B1.0\|REF99_V4\|3374 | 22 | 34 | 20 | 6 | | | | | | | | | | | | | | | | | | | | |
| 815 | 683 | B1.0\|REF99_V4\|2385 | 916 | B1.0\|REF99_V4\|3675 | 22 | 40 | 21 | 7 | | | | | | | | | | | | | | | | | | | | |
| 816 | 683 | B1.0\|REF99_V4\|2385 | 1007 | B1.0\|REF99_V4\|49526 | 22 | 42 | 20 | 7 | | | | | | | | | | | | | | | | | | | | |
| 817 | 810 | B1.0\|REF99_V4\|4250 | 131 | B1.0\|REF99_V4\|4251 | 39 | 33 | 26 | 10 | | | | | | | | | | | | | | | | | | | | |
| 818 | 810 | B1.0\|REF99_V4\|4250 | 845 | B1.0\|REF99_V4\|42959 | 39 | 25 | 24 | 8 | | | | | | | | | | | | | | | | | | | | |
| 819 | 810 | B1.0\|REF99_V4\|4250 | 963 | B1.0\|REF99_V4\|433855 | 39 | 27 | 24 | 8 | | | | | | | | | | | | | | | | | | | | |
| 820 | 810 | B1.0\|REF99_V4\|4250 | 719 | B1.0\|REF99_V4\|4385 | 39 | 52 | 30 | 16 | | | | | | | | | | | | | | | | | | | | |
| 821 | 810 | B1.0\|REF99_V4\|4250 | 945 | B1.0\|REF99_V4\|4442 | 39 | 27 | 25 | 8 | | | | | | | | | | | | | | | | | | | | |
| 822 | 810 | B1.0\|REF99_V4\|4250 | 69 | B1.0\|REF99_V4\|4506 | 39 | 25 | 22 | 6 | | | | | | | | | | | | | | | | | | | | |
| 823 | 810 | B1.0\|REF99_V4\|4250 | 60 | B1.0\|REF99_V4\|4514 | 39 | 23 | 22 | 7 | | | | | | | | | | | | | | | | | | | | |
| 824 | 810 | B1.0\|REF99_V4\|4250 | 818 | B1.0\|REF99_V4\|4531 | 39 | 38 | 26 | 12 | | | | | | | | | | | | | | | | | | | | |
| 825 | 810 | B1.0\|REF99_V4\|4250 | 734 | B1.0\|REF99_V4\|4558 | 39 | 32 | 24 | 10 | | | | | | | | | | | | | | | | | | | | |
| 826 | 810 | B1.0\|REF99_V4\|4250 | 775 | B1.0\|REF99_V4\|4635 | 39 | 21 | 20 | 6 | | | | | | | | | | | | | | | | | | | | |
| 827 | 810 | B1.0\|REF99_V4\|4250 | 319 | B1.0\|REF99_V4\|70731 | 39 | 24 | 22 | 7 | | | | | | | | | | | | | | | | | | | | |
| 828 | 810 | B1.0\|REF99_V4\|4250 | 943 | B1.0\|REF99_V4\|26030 | 33 | 31 | 22 | 8 | | | | | | | | | | | | | | | | | | | | |
| 829 | 131 | B1.0\|REF99_V4\|4251 | 963 | B1.0\|REF99_V4\|433855 | 33 | 27 | 21 | 7 | | | | | | | | | | | | | | | | | | | | |
| 830 | 131 | B1.0\|REF99_V4\|4251 | 880 | B1.0\|REF99_V4\|4472 | 33 | 22 | 23 | 8 | | | | | | | | | | | | | | | | | | | | |
| 831 | 131 | B1.0\|REF99_V4\|4251 | 734 | B1.0\|REF99_V4\|4558 | 33 | 32 | 24 | 8 | | | | | | | | | | | | | | | | | | | | |
| 832 | 131 | B1.0\|REF99_V4\|4251 | 915 | B1.0\|REF99_V4\|4884 | 33 | 27 | 21 | 7 | | | | | | | | | | | | | | | | | | | | |
| 833 | 131 | B1.0\|REF99_V4\|4251 | 945 | B1.0\|REF99_V4\|4442 | 31 | 27 | 21 | 7 | | | | | | | | | | | | | | | | | | | | |
| 834 | 943 | B1.0\|REF99_V4\|26030 | 845 | B1.0\|REF99_V4\|42959 | 42 | 25 | 25 | 8 | | | | | | | | | | | | | | | | | | | | |
| 835 | 974 | B1.0\|REF99_V4\|2831 | 719 | B1.0\|REF99_V4\|4385 | 42 | 52 | 31 | 17 | | | | | | | | | | | | | | | | | | | | |
| 836 | 974 | B1.0\|REF99_V4\|2831 | 818 | B1.0\|REF99_V4\|4531 | 42 | 38 | 27 | 13 | | | | | | | | | | | | | | | | | | | | |
| 837 | 974 | B1.0\|REF99_V4\|2831 | 734 | B1.0\|REF99_V4\|4558 | 42 | 32 | 26 | 11 | | | | | | | | | | | | | | | | | | | | |
| 838 | 974 | B1.0\|REF99_V4\|2831 | 775 | B1.0\|REF99_V4\|4635 | 42 | 21 | 21 | 7 | | | | | | | | | | | | | | | | | | | | |

TABLE 12-continued

| A | B | C | D | E | | F Bacteria - cultivated | | | | G Bacteria - cultivated, roots | | | | H Bacteria - cultivated, seeds | | | | I Bacteria - wild | | | | J Bacteria - wild, roots | | | | K Bacteria - wild, seeds | | | |
|---|---|---|---|---|---|---|---|---|---|---|---|---|---|---|---|---|---|---|---|---|---|---|---|---|---|---|---|---|---|
| PAIR | Endophyte 1 (SEQ ID NO:) | Endophyte 1 (OTU) | Endophyte 2 (SEQ ID NO:) | Endophyte 2 (OTU) | | N1 | N2 | OC | EC | N1 | N2 | OC | EC | N1 | N2 | OC | EC | N1 | N2 | OC | EC | N1 | N2 | OC | EC | N1 | N2 | OC | EC |
| 839 | 845 | B1.0|REF99_V4|2959 | 916 | B1.0|REF99_V4|3675 | | 25 | 40 | 23 | 8 | | | | | | | | | | | | | | | | | | | | |
| 840 | 845 | B1.0|REF99_V4|2959 | 945 | B1.0|REF99_V4|4442 | | 25 | 27 | 18 | 5 | | | | | | | | | | | | | | | | | | | | |
| 841 | 845 | B1.0|REF99_V4|2959 | 60 | B1.0|REF99_V4|4514 | | 25 | 23 | 18 | 8 | | | | | | | | | | | | | | | | | | | | |
| 842 | 845 | B1.0|REF99_V4|2959 | 1012 | B1.0|REF99_V4|4597 | | 25 | 39 | 23 | 8 | 25 | 23 | 18 | 13.7 | | | | | | | | | | | | | | | |
| 843 | 845 | B1.0|REF99_V4|2959 | 837 | B1.0|REF99_V4|4720 | | 25 | 55 | 25 | 11 | | | | | | | | | | | | | | | | | | | | |
| 844 | 845 | B1.0|REF99_V4|2959 | 1007 | B1.0|REF99_V4|9526 | | 25 | 42 | 23 | 8 | | | | | | | | | | | | | | | | | | | | |
| 845 | 615 | B1.0|REF99_V4|3374 | 945 | B1.0|REF99_V4|4442 | | 34 | 27 | 23 | 7 | | | | | | | | | | | | | | | | | | | | |
| 846 | 615 | B1.0|REF99_V4|3374 | 60 | B1.0|REF99_V4|4514 | | 34 | 23 | 19 | 6 | | | | | | | | | | | | | | | | | | | | |
| 847 | 963 | B1.0|REF99_V4|33855 | 945 | B1.0|REF99_V4|4442 | | 27 | 28 | 19 | 6 | | | | | | | | | | | | | | | | | | | | |
| 848 | 963 | B1.0|REF99_V4|33855 | 837 | B1.0|REF99_V4|4720 | | 27 | 55 | 27 | 12 | | | | | | | | | | | | | | | | | | | | |
| 849 | 963 | B1.0|REF99_V4|33855 | 915 | B1.0|REF99_V4|4884 | | 27 | 27 | 19 | 6 | | | | | | | | | | | | | | | | | | | | |
| 850 | 961 | B1.0|REF99_V4|3580 | 916 | B1.0|REF99_V4|3675 | | 21 | 40 | 20 | 7 | | | | | | | | | | | | | | | | | | | | |
| 851 | 961 | B1.0|REF99_V4|3580 | 1007 | B1.0|REF99_V4|9526 | | 21 | 42 | 20 | 7 | | | | | | | | | | | | | | | | | | | | |
| 852 | 916 | B1.0|REF99_V4|3675 | 719 | B1.0|REF99_V4|385 | | 40 | 52 | 30 | 16 | | | | | | | | | | | | | | | | | | | | |
| 853 | 916 | B1.0|REF99_V4|3675 | 60 | B1.0|REF99_V4|4514 | | 40 | 23 | 21 | 7 | | | | | | | | | | | | | | | | | | | | |
| 854 | 916 | B1.0|REF99_V4|3675 | 818 | B1.0|REF99_V4|531 | | 40 | 38 | 25 | 12 | | | | | | | | | | | | | | | | | | | | |
| 855 | 916 | B1.0|REF99_V4|3675 | 734 | B1.0|REF99_V4|558 | | 40 | 32 | 24 | 10 | | | | | | | | | | | | | | | | | | | | |
| 856 | 916 | B1.0|REF99_V4|3675 | 775 | B1.0|REF99_V4|635 | | 40 | 32 | 21 | 7 | | | | | | | | | | | | | | | | | | | | |
| 857 | 719 | B1.0|REF99_V4|385 | 1012 | B1.0|REF99_V4|4597 | | 52 | 39 | 30 | 16 | | | | | | | | | | | | | | | | | | | | |
| 858 | 719 | B1.0|REF99_V4|385 | 837 | B1.0|REF99_V4|4720 | | 52 | 55 | 39 | 23 | | | | | | | | | | | | | | | | | | | | |
| 859 | 719 | B1.0|REF99_V4|385 | 1007 | B1.0|REF99_V4|9526 | | 52 | 42 | 30 | 17 | | | | | | | | | | | | | | | | | | | | |
| 860 | 945 | B1.0|REF99_V4|4442 | 837 | B1.0|REF99_V4|4720 | | 27 | 55 | 27 | 12 | | | | | | | | | 21 | 37 | 21 | 5 | | | | | | | | |
| 861 | 945 | B1.0|REF99_V4|4442 | 713 | B1.0|REF99_V4|4754 | | 27 | 36 | 22 | 8 | | | | | | | | | | | | | | | | | | | | |
| 862 | 945 | B1.0|REF99_V4|4442 | 1007 | B1.0|REF99_V4|9526 | | 27 | 42 | 26 | 9 | | | | | | | | | | | | | | | | | | | | |
| 863 | 880 | B1.0|REF99_V4|4472 | 69 | B1.0|REF99_V4|506 | | 31 | 25 | 19 | 6 | | | | | | | | | | | | | | | | | | | | |
| 864 | 880 | B1.0|REF99_V4|4472 | 734 | B1.0|REF99_V4|635 | | 31 | 32 | 22 | 8 | | | | | | | | | | | | | | | | | | | | |
| 865 | 880 | B1.0|REF99_V4|4472 | 319 | B1.0|REF99_V4|4597 | | 31 | 24 | 20 | 6 | | | | | | | | | | | | | | | | | | | | |
| 866 | 60 | B1.0|REF99_V4|4514 | 1012 | B1.0|REF99_V4|4597 | | 23 | 39 | 22 | 7 | | | | | | | | | | | | | | | | | | | | |
| 867 | 60 | B1.0|REF99_V4|4514 | 837 | B1.0|REF99_V4|4720 | | 23 | 55 | 23 | 10 | | | | | | | | | | | | | | | | | | | | |
| 868 | 60 | B1.0|REF99_V4|4514 | 1007 | B1.0|REF99_V4|9526 | | 23 | 42 | 21 | 8 | | | | | | | | | | | | | | | | | | | | |
| 869 | 818 | B1.0|REF99_V4|531 | 837 | B1.0|REF99_V4|4720 | | 38 | 42 | 26 | 13 | | | | | | | | | | | | | | | | | | | | |
| 870 | 734 | B1.0|REF99_V4|558 | 1007 | B1.0|REF99_V4|9526 | | 32 | 39 | 24 | 10 | | | | | | | | | | | | | | | | | | | | |
| 871 | 734 | B1.0|REF99_V4|558 | 319 | B1.0|REF99_V4|70731 | | 32 | 55 | 30 | 14 | | | | | | | | | | | | | | | | | | | | |
| 872 | 734 | B1.0|REF99_V4|558 | 1012 | B1.0|REF99_V4|4597 | | 32 | 36 | 22 | 9 | | | | | | | | | | | | | | | | | | | | |
| 873 | 1012 | B1.0|REF99_V4|4597 | 1007 | B1.0|REF99_V4|9526 | | 32 | 42 | 25 | 11 | | | | | | | | | | | | | | | | | | | | |
| 874 | 775 | B1.0|REF99_V4|635 | 319 | B1.0|REF99_V4|70731 | | 39 | 24 | 21 | 7 | | | | | | | | | | | | | | | | | | | | |
| 875 | 430 | B1.0|REF99_V4|659 | 1007 | B1.0|REF99_V4|9526 | | 21 | 42 | 21 | 7 | | | | | | | | | | | | | | | | | | | | |
| 876 | 319 | B1.0|REF99_V4|70731 | 837 | B1.0|REF99_V4|4720 | | 32 | 55 | 28 | 14 | | | | | | | | | | | | | | | | | | | | |
| 877 | 319 | B1.0|REF99_V4|70731 | 837 | B1.0|REF99_V4|4720 | | 24 | 55 | 24 | 10 | | | | | | | | | | | | | | | | | | | | |
| 878 | 959 | B1.0|REF97_V4|126 | 713 | B1.0|REF99_V4|4754 | | 24 | 36 | 20 | 7 | | | | | | | | | | | | | | | | | | | | |
| 879 | 959 | B1.0|REF97_V4|127 | 1089 | B1.0|REF99_V4|4127 | | | | | | 22 | 22 | 16 | 11.5 | | | | | | | | | | | | | | | | | |
| 880 | 1089 | B1.0|REF99_V4|4127 | 1003 | B1.0|REF99_V4|4502 | | | | | | 22 | 9 | 9 | 4.7 | | | | | | | | | | | | | | | | | |
| 881 | 1171 | B1.0|REF97_V4|1639 | 892 | B1.0|REF99_V4|1177 | | | | | | 11 | 21 | 10 | 5.5 | | | | | | | | | | | | | | | | | |
| 882 | 1171 | B1.0|REF97_V4|1639 | 1171 | B1.0|REF99_V4|1639 | | | | | | 11 | 21 | 11 | 5.5 | | | | | | | | | | | | | | | | | |
| 883 | 1171 | B1.0|REF97_V4|1639 | 870 | B1.0|REF99_V4|5106 | | | | | | 11 | 10 | 8 | 2.6 | | | | | | | | | | | | | | | | | |
| 884 | 1180 | B1.0|REF97_V4|166 | 1180 | B1.0|REF99_V4|166 | | | | | | 14 | 29 | 14 | 9.7 | | | | | | | | | | | | | | | | | |

TABLE 12-continued

| PAIR | B Endophyte 1 (SEQ ID NO:) | C Endophyte 1 (OTU) | D Endophyte 2 (SEQ ID NO:) | E Endophyte 2 (OTU) | F Bacteria - cultivated N1 | F N2 | F OC | F EC | G Bacteria - cultivated, roots N1 | G N2 | G OC | G EC | H Bacteria - cultivated, seeds N1 | H N2 | H OC | H EC | I Bacteria - wild N1 | I N2 | I OC | I EC | J Bacteria - wild, roots N1 | J N2 | J OC | J EC | K Bacteria - wild, seeds N1 | K N2 | K OC | K EC |
|---|---|---|---|---|---|---|---|---|---|---|---|---|---|---|---|---|---|---|---|---|---|---|---|---|---|---|---|---|
| 885 | 430 | B1.0|REF97_V4|659 | 839 | B1.0|REF99_V4|1186 | | | | | 10 | 24 | 10 | 5.7 | | | | | | | | | | | | | | | | |
| 886 | 430 | B1.0|REF97_V4|659 | 430 | B1.0|REF99_V4|659 | | | | | 10 | 19 | 10 | 4.5 | | | | | | | | | | | | | | | | |
| 887 | 1010 | B1.0|REF97_V4|7846 | 642 | B1.0|REF99_V4|108061 | | | | | 6 | 10 | 6 | 1.4 | | | | | | | | | | | | | | | | |
| 888 | 1007 | B1.0|REF97_V4|9526 | 890 | B1.0|REF99_V4|811 | | | | | 30 | 15 | 15 | 10.7 | | | | | | | | | | | | | | | | |
| 889 | 944 | B1.0|REF99_V4|101700 | 706 | B1.0|REF99_V4|12451 | | | | | 11 | 22 | 10 | 5.8 | | | | | | | | | | | | | | | | |
| 890 | 944 | B1.0|REF99_V4|101700 | 653 | B1.0|REF99_V4|4995 | | | | | 11 | 21 | 13 | 5.5 | | | | | | | | | | | | | | | | |
| 891 | 962 | B1.0|REF99_V4|102519 | 1177 | B1.0|REF99_V4|464 | | | | | 19 | 19 | 13 | 8.6 | | | | | | | | | | | | | | | | |
| 892 | 642 | B1.0|REF99_V4|108061 | 865 | B1.0|REF99_V4|9100 | | | | | 10 | 9 | 7 | 2.1 | | | | | | | | | | | | | | | | |
| 893 | 884 | B1.0|REF99_V4|1164 | 890 | B1.0|REF99_V4|811 | | | | | 30 | 15 | 15 | 10.7 | | | | | | | | | | | | | | | | |
| 894 | 892 | B1.0|REF99_V4|1177 | 879 | B1.0|REF99_V4|1349 | | | | | 21 | 11 | 10 | 5.5 | | | | | | | | | | | | | | | | |
| 895 | 892 | B1.0|REF99_V4|1177 | 889 | B1.0|REF99_V4|4185 | | | | | 21 | 25 | 17 | 12.5 | | | | | | | | | | | | | | | | |
| 896 | 892 | B1.0|REF99_V4|1177 | 653 | B1.0|REF99_V4|4995 | | | | | 21 | 21 | 15 | 10.5 | | | | | | | | | | | | | | | | |
| 897 | 54 | B1.0|REF99_V4|118524 | 706 | B1.0|REF99_V4|12451 | | | | | 22 | 22 | 16 | 11.5 | | | | | | | | | | | | | | | | |
| 898 | 54 | B1.0|REF99_V4|118524 | 683 | B1.0|REF99_V4|2385 | | | | | 22 | 22 | 16 | 11.5 | | | | | | | | | | | | | | | | |
| 899 | 121 | B1.0|REF99_V4|1211 | 957 | B1.0|REF99_V4|921 | | | | | 25 | 13 | 13 | 7.7 | | | | | | | | | 52 | 46 | 33 | 19 |
| 900 | 706 | B1.0|REF99_V4|12451 | 1184 | B1.0|REF99_V4|20510 | | | | | 22 | 22 | 16 | 11.5 | | | | | | | | | | | | | | | | |
| 901 | 886 | B1.0|REF99_V4|1287 | 646 | B1.0|REF99_V4|2611 | | | | | 24 | 13 | 12 | 7.4 | | | | | | | | | | | | | | | | |
| 902 | 329 | B1.0|REF99_V4|13091 | 60 | B1.0|REF99_V4|514 | | | | | 12 | 23 | 11 | 6.6 | | | | | | | | | | | | | | | | |
| 903 | 939 | B1.0|REF99_V4|1317 | 1177 | B1.0|REF99_V4|464 | | | | | 26 | 19 | 16 | 11.8 | | | | | | | | | | | | | | | | |
| 904 | 879 | B1.0|REF99_V4|1349 | 890 | B1.0|REF99_V4|811 | | | | | 11 | 15 | 9 | 3.9 | | | | | | | | | | | | | | | | |
| 905 | 628 | B1.0|REF99_V4|136920 | 812 | B1.0|REF99_V4|2419 | | | | | 17 | 9 | 9 | 3.6 | | | | | | | | | | | | | | | | |
| 906 | 628 | B1.0|REF99_V4|136920 | 334 | B1.0|REF99_V4|9277 | | | | | 17 | 9 | 8 | 3.6 | | | | | | | | | | | | | | | | |
| 907 | 260 | B1.0|REF99_V4|14662 | 739 | B1.0|REF99_V4|1562 | | | | | 25 | 20 | 17 | 11.9 | | | | | | | | | | | | | | | | |
| 908 | 260 | B1.0|REF99_V4|14662 | 653 | B1.0|REF99_V4|4995 | | | | | 25 | 21 | 15 | 12.5 | | | | | | | | | | | | | | | | |
| 909 | 739 | B1.0|REF99_V4|1562 | 313 | B1.0|REF99_V4|18024 | | | | | 20 | 21 | 15 | 10 | | | | | | | | | | | | | | | | |
| 910 | 739 | B1.0|REF99_V4|1562 | 337 | B1.0|REF99_V4|180548 | | | | | 20 | 12 | 10 | 5.7 | | | | | | | | | | | | | | | | |
| 911 | 739 | B1.0|REF99_V4|1562 | 719 | B1.0|REF99_V4|4385 | | | | | 22 | 31 | 19 | 14.8 | | | | | | | | | | | | | | | | |
| 912 | 814 | B1.0|REF99_V4|1673 | 430 | B1.0|REF99_V4|659 | | | | | 25 | 19 | 16 | 11.3 | | | | | | | | | | | | | | | | |
| 913 | 1248 | B1.0|REF99_V4|1792 | 865 | B1.0|REF99_V4|9100 | | | | | 7 | 9 | 6 | 1.5 | | | | | | | | | | | | | | | | |
| 914 | 1184 | B1.0|REF99_V4|20510 | 845 | B1.0|REF99_V4|2959 | | | | | 22 | 25 | 19 | 13.1 | | | | | | | | | | | | | | | | |
| 915 | 1184 | B1.0|REF99_V4|20510 | 957 | B1.0|REF99_V4|921 | | | | | 22 | 13 | 12 | 6.8 | | | | | | | | | | | | | | | | |
| 916 | 864 | B1.0|REF99_V4|4217 | 945 | B1.0|REF99_V4|442 | | | | | 12 | 27 | 10 | 7.7 | | | | | | | | | | | | | | | | |
| 917 | 693 | B1.0|REF99_V4|22483 | 689 | B1.0|REF99_V4|2546 | | | | | 9 | 10 | 8 | 2.1 | | | | | | | | | | | | | | | | |
| 918 | 683 | B1.0|REF99_V4|2385 | 691 | B1.0|REF99_V4|2533 | | | | | 22 | 13 | 11 | 6.8 | | | | | | | | | | | | | | | | |
| 919 | 812 | B1.0|REF99_V4|2419 | 646 | B1.0|REF99_V4|2611 | | | | | 9 | 13 | 7 | 2.8 | | | | | | | | | | | | | | | | |
| 920 | 812 | B1.0|REF99_V4|2419 | 665 | B1.0|REF99_V4|4446 | | | | | 9 | 18 | 9 | 3.9 | | | | | | | | | | | | | | | | |
| 921 | 1221 | B1.0|REF99_V4|2512 | 665 | B1.0|REF99_V4|4446 | | | | | 22 | 18 | 15 | 9.4 | | | | | | | | | | | | | | | | |
| 922 | 1221 | B1.0|REF99_V4|2512 | 865 | B1.0|REF99_V4|9100 | | | | | 22 | 9 | 9 | 4.7 | | | | | | | | | | | | | | | | |
| 923 | 845 | B1.0|REF99_V4|2959 | 819 | B1.0|REF99_V4|3592 | | | | | 25 | 17 | 15 | 10.1 | | | | | | | | | | | | | | | | |
| 924 | 845 | B1.0|REF99_V4|2959 | 957 | B1.0|REF99_V4|921 | | | | | 22 | 13 | 11 | 6.8 | | | | | | | | | | | | | | | | |
| 925 | 961 | B1.0|REF99_V4|3580 | 853 | B1.0|REF99_V4|2611 | | | | | 25 | 13 | 12 | 7.7 | | | | | | | | | | | | | | | | |
| 926 | 961 | B1.0|REF99_V4|3580 | 968 | B1.0|REF99_V4|5965 | | | | | 21 | 17 | 14 | 8.5 | | | | | | | | | | | | | | | | |
| 927 | 819 | B1.0|REF99_V4|3592 | 665 | B1.0|REF99_V4|4446 | | | | | 21 | 21 | 17 | 9.4 | | | | | | | | | | | | | | | | |
| 928 | 388 | B1.0|REF99_V4|5893 | 430 | B1.0|REF99_V4|659 | | | | | 17 | 19 | 13 | 7.7 | | | | | | | | | | | | | | | | |
| 929 | 775 | B1.0|REF99_V4|635 | 890 | B1.0|REF99_V4|811 | | | | | 10 | 15 | 8 | 3.6 | | | | | | | | | | | | | | | | |
| 930 | 775 | B1.0|REF99_V4|635 | 968 | B1.0|REF99_V4|972 | | | | | 21 | 17 | 13 | 8.5 | | | | | | | | | | | | | | | | |

TABLE 12-continued

| A PAIR | B Endophyte 1 (SEQ ID NO:) | C Endophyte 1 (OTU) | D Endophyte 2 (SEQ ID NO:) | E Endophyte 2 (OTU) | F Bacteria - cultivated | | | | G Bacteria - cultivated, roots | | | | H Bacteria - cultivated, seeds | | | | I Bacteria - wild | | | | J Bacteria - wild, roots | | | | K Bacteria - wild, seeds | | | |
|---|---|---|---|---|---|---|---|---|---|---|---|---|---|---|---|---|---|---|---|---|---|---|---|---|---|---|---|---|
| | | | | | N1 | N2 | OC | EC | N1 | N2 | OC | EC | N1 | N2 | OC | EC | N1 | N2 | OC | EC | N1 | N2 | OC | EC | N1 | N2 | OC | EC |
| 931 | 890 | B1.0|REF99_V4|811 | 653 | B1.0|REF99_V4|995 | | | | | 15 | 21 | 12 | 7.5 | | | | | | | | | | | | | | | | |
| 932 | 865 | B1.0|REF99_V4|9100 | 957 | B1.0|REF99_V4|921 | | | | | 9 | 13 | 7 | 2.8 | | | | | | | | | | | | | | | | |
| 933 | 1108 | B1.0|REF97_V4|1 | 1086 | B1.0|REF99_V4|25794 | | | | | | | | | 16 | 26 | 14 | 5 | | | | | | | | | 32 | 47 | 32 | 12 |
| 934 | 1089 | B1.0|REF97_V4|127 | 1088 | B1.0|REF99_V4|1703 | | | | | | | | | 29 | 44 | 24 | 15 | | | | | | | | | | | | |
| 935 | 1191 | B1.0|REF97_V4|150716 | 1098 | B1.0|REF97_V4|1 | | | | | | | | | 28 | 19 | 16 | 6 | | | | | | | | | | | | |
| 936 | 1191 | B1.0|REF97_V4|150716 | 121 | B1.0|REF99_V4|1211 | | | | | | | | | 28 | 21 | 16 | 7 | | | | | | | | | 50 | 52 | 35 | 21 |
| 937 | 1191 | B1.0|REF97_V4|150716 | 1104 | B1.0|REF99_V4|122519 | | | | | | | | | 28 | 22 | 17 | 7 | | | | | | | | | | | | |
| 938 | 1191 | B1.0|REF97_V4|150716 | 1158 | B1.0|REF99_V4|1323 | | | | | | | | | 28 | 31 | 20 | 10 | | | | | | | | | | | | |
| 939 | 1191 | B1.0|REF97_V4|150716 | 1098 | B1.0|REF97_V4|1 | | | | | | | | | 28 | 53 | 26 | 18 | | | | | | | | | | | | |
| 940 | 566 | B1.0|REF97_V4|16938 | 563 | B1.0|REF97_V4|44943 | | | | | | | | | 12 | 11 | 11 | 2 | | | | | | | | | | | | |
| 941 | 566 | B1.0|REF97_V4|16938 | 566 | B1.0|REF97_V4|16938 | | | | | | | | | 12 | 19 | 12 | 3 | | | | | | | | | | | | |
| 942 | 566 | B1.0|REF97_V4|16938 | 568 | B1.0|REF99_V4|4285 | | | | | | | | | 12 | 26 | 12 | 4 | | | | | | | | | | | | |
| 943 | 566 | B1.0|REF97_V4|16938 | 563 | B1.0|REF97_V4|44943 | | | | | | | | | 12 | 12 | 11 | 2 | | | | | | | | | | | | |
| 944 | 1098 | B1.0|REF97_V4|1 | 1091 | B1.0|REF99_V4|15 | | | | | | | | | 19 | 26 | 15 | 6 | | | | | | | | | | | | |
| 945 | 1098 | B1.0|REF97_V4|1 | 1191 | B1.0|REF97_V4|150716 | | | | | | | | | 19 | 31 | 16 | 7 | | | | | | | | | | | | |
| 946 | 1098 | B1.0|REF97_V4|1 | 1086 | B1.0|REF99_V4|25794 | | | | | | | | | 19 | 26 | 15 | 6 | | | | | | | | | | | | |
| 947 | 1098 | B1.0|REF97_V4|1 | 957 | B1.0|REF99_V4|921 | | | | | | | | | 19 | 32 | 16 | 7 | | | | | | | | | | | | |
| 948 | 460 | B1.0|REF97_V4|177738 | 460 | B1.0|REF99_V4|177738 | | | | | | | | | 15 | 13 | 12 | 2 | | | | | | | | | | | | |
| 949 | 563 | B1.0|REF97_V4|44943 | 566 | B1.0|REF99_V4|16938 | | | | | | | | | 11 | 19 | 11 | 3 | | | | | | | | | | | | |
| 950 | 563 | B1.0|REF97_V4|44943 | 564 | B1.0|REF99_V4|3624 | | | | | | | | | 11 | 19 | 11 | 3 | | | | | | | | | | | | |
| 951 | 510 | B1.0|REF97_V4|48981 | 111 | B1.0|REF99_V4|1256 | | | | | | | | | 23 | 22 | 15 | 6 | | | | | | | | | | | | |
| 952 | 850 | B1.0|REF97_V4|11157 | 804 | B1.0|REF99_V4|1838 | | | | | | | | | 20 | 14 | 13 | 3 | 39 | 47 | 32 | 12 | | | | | 39 | 29 | 23 | 9 |
| 953 | 850 | B1.0|REF97_V4|11157 | 816 | B1.0|REF99_V4|21134 | | | | | | | | | 20 | 16 | 14 | 4 | | | | | | | | | 39 | 26 | 21 | 8 |
| 954 | 850 | B1.0|REF97_V4|11157 | 907 | B1.0|REF99_V4|4661 | | | | | | | | | 20 | 14 | 12 | 3 | | | | | | | | | | | | |
| 955 | 1104 | B1.0|REF97_V4|122519 | 1191 | B1.0|REF99_V4|150716 | | | | | | | | | 22 | 31 | 17 | 8 | | | | | | | | | | | | |
| 956 | 1104 | B1.0|REF97_V4|122519 | 1086 | B1.0|REF99_V4|25794 | | | | | | | | | 22 | 26 | 16 | 7 | | | | | | | | | | | | |
| 957 | 1104 | B1.0|REF97_V4|122519 | 957 | B1.0|REF99_V4|921 | | | | | | | | | 22 | 32 | 17 | 8 | | | | | | | | | | | | |
| 958 | 1158 | B1.0|REF99_V4|1256 | 510 | B1.0|REF99_V4|48981 | | | | | | | | | 22 | 26 | 16 | 7 | | | | | | | | | | | | |
| 959 | 1158 | B1.0|REF99_V4|1323 | 972 | B1.0|REF99_V4|4218 | | | | | | | | | 31 | 32 | 21 | 12 | | | | | | | | | | | | |
| 960 | 1112 | B1.0|REF99_V4|14460 | 1092 | B1.0|REF99_V4|476 | | | | | | | | | 40 | 26 | 21 | 12 | | | | | | | | | | | | |
| 961 | 1091 | B1.0|REF99_V4|15 | 1094 | B1.0|REF99_V4|4387 | | | | | | | | | 26 | 27 | 18 | 8 | | | | | | | | | | | | |
| 962 | 1191 | B1.0|REF99_V4|150716 | 1098 | B1.0|REF99_V4|4171 | | | | | | | | | 31 | 53 | 28 | 19 | 53 | 45 | 31 | 15 | | | | | 53 | 41 | 31 | 18 |
| 963 | 1191 | B1.0|REF99_V4|150716 | 510 | B1.0|REF99_V4|48981 | | | | | | | | | 31 | 26 | 20 | 10 | | | | | | | | | | | | |
| 964 | 471 | B1.0|REF99_V4|151 | 495 | B1.0|REF99_V4|9 | | | | | | | | | 25 | 20 | 15 | 6 | | | | | | | | | | | | |
| 965 | 512 | B1.0|REF99_V4|15428 | 505 | B1.0|REF99_V4|7082 | | | | | | | | | 17 | 20 | 13 | 4 | | | | | | | | | | | | |
| 966 | 566 | B1.0|REF99_V4|16938 | 568 | B1.0|REF99_V4|4285 | | | | | | | | | 19 | 25 | 15 | 6 | | | | | | | | | | | | |
| 967 | 566 | B1.0|REF99_V4|16938 | 564 | B1.0|REF99_V4|3624 | | | | | | | | | 19 | 19 | 15 | 4 | | | | | | | | | | | | |
| 968 | 684 | B1.0|REF99_V4|172 | 702 | B1.0|REF99_V4|5579 | | | | | | | | | 34 | 20 | 19 | 8 | | | | | | | | | 60 | 42 | 38 | 21 |
| 969 | 684 | B1.0|REF99_V4|172 | 957 | B1.0|REF99_V4|921 | | | | | | | | | 34 | 32 | 22 | 13 | | | | | | | | | 60 | 41 | 36 | 20 |
| 970 | 684 | B1.0|REF99_V4|172 | 1134 | B1.0|REF99_V4|4986 | | | | | | | | | 34 | 17 | 16 | 7 | | | | | | | | | 29 | 26 | 20 | 6 |
| 971 | 804 | B1.0|REF99_V4|1838 | 816 | B1.0|REF99_V4|21134 | | | | | | | | | 14 | 16 | 12 | 3 | | | | | | | | | | | | |
| 972 | 804 | B1.0|REF99_V4|1838 | 430 | B1.0|REF99_V4|4659 | | | | | | | | | 14 | 13 | 11 | 2 | | | | | | | | | | | | |
| 973 | 1080 | B1.0|REF99_V4|419 | 1077 | B1.0|REF99_V4|4209 | | | | | | | | | 22 | 23 | 15 | 6 | | | | | | | | | | | | |
| 974 | 816 | B1.0|REF99_V4|21134 | 907 | B1.0|REF99_V4|4661 | | | | | | | | | 16 | 14 | 12 | 3 | 39 | 65 | 34 | 16 | | | | | 38 | 64 | 34 | 20 |
| 975 | 816 | B1.0|REF99_V4|21134 | 430 | B1.0|REF99_V4|4659 | | | | | | | | | 16 | 13 | 11 | 2 | | | | | | | | | | | | |
| 976 | 688 | B1.0|REF99_V4|25052 | 837 | B1.0|REF99_V4|4720 | | | | | | | | | 10 | 13 | 10 | 2 | | | | | | | | | | | | |

TABLE 12-continued

| A | B | C | D | E | F Bacteria - cultivated | | | G Bacteria - cultivated, roots | | | H Bacteria - cultivated, seeds | | | I Bacteria - wild | | | J Bacteria - wild, roots | | | K Bacteria - wild, seeds | | |
|---|---|---|---|---|---|---|---|---|---|---|---|---|---|---|---|---|---|---|---|---|---|---|---|
| PAIR | Endophyte 1 (SEQ ID NO:) | Endophyte 1 (OTU) | Endophyte 2 (SEQ ID NO:) | Endophyte 2 (OTU) | N1 | N2 | OC | EC | N1 | N2 | OC | EC | N1 | N2 | OC | EC | N1 | N2 | OC | EC | N1 | N2 | OC | EC |
| 977 | 1109 | B1.0|REF99_V4|25629 | 1094 | B1.0|REF99_V4|387 | | | | | | | | 38 | 27 | 25 | 12 | | | | | | | | |
| 978 | 1086 | B1.0|REF99_V4|25794 | 1094 | B1.0|REF99_V4|387 | | | | | | | | 26 | 27 | 17 | 8 | | | | | | | | |
| 979 | 1086 | B1.0|REF99_V4|25794 | 1092 | B1.0|REF99_V4|476 | | | | | | | | 26 | 26 | 18 | 8 | | | | | | | | |
| 980 | 1094 | B1.0|REF99_V4|387 | 1092 | B1.0|REF99_V4|476 | | | | | | | | 27 | 26 | 18 | 8 | | | | | | | | |
| 981 | 332 | B1.0|REF97_V4|10068 | 332 | B1.0|REF99_V4|10068 | | | | | | | | | | | | | | | | | | | |
| 990 | 1106 | B1.0|REF97_V4|66 | 939 | B1.0|REF99_V4|41317 | | | | | | | | | | | | 7 | 17 | 7 | 3 | 47 | | | |
| 995 | 670 | B1.0|REF99_V4|10019 | 43 | B1.0|REF99_V4|42265 | | | | | | | | | | | | 22 | 19 | 15 | 11 | | | | |
| 1005 | 1245 | B1.0|REF99_V4|12375 | 719 | B1.0|REF99_V4|4385 | | | | | | | | | | | | 7 | 10 | 6 | 2 | | | | |
| 1009 | 1245 | B1.0|REF99_V4|12375 | 968 | B1.0|REF99_V4|4972 | | | | | | | | | | | | 12 | 20 | 11 | 7 | | | | |
| 1015 | 1013 | B1.0|REF99_V4|13951 | 818 | B1.0|REF99_V4|4531 | | | | | | | | | | | | 12 | 13 | 8 | 4 | | | | |
| 1016 | 1013 | B1.0|REF99_V4|13951 | 994 | B1.0|REF99_V4|48340 | | | | | | | | | | | | 17 | 17 | 14 | 8 | | | | |
| 1023 | 613 | B1.0|REF99_V4|4200 | 818 | B1.0|REF99_V4|4531 | | | | | | | | | | | | 17 | 17 | 10 | 9 | | | | |
| 1026 | 719 | B1.0|REF99_V4|4385 | 388 | B1.0|REF99_V4|5893 | | | | | | | | | | | | 17 | 17 | 13 | 8 | | | | |
| 1028 | 529 | B1.0|REF99_V4|43983 | 506 | B1.0|REF99_V4|4951 | | | | | | | | | | | | 20 | 11 | 10 | 6 | | | | |
| 1033 | 388 | B1.0|REF99_V4|5893 | 853 | B1.0|REF99_V4|45965 | | | | | | | | | | | | 22 | 17 | 14 | 10 | | | | |
| 1035 | 1108 | B1.0|REF99_V4|41 | 1091 | B1.0|REF99_V4|415 | | | | | | | | | | | | 11 | 14 | 10 | 4 | | | | |
| 1036 | 1108 | B1.0|REF99_V4|41 | 1097 | B1.0|REF99_V4|159716 | | | | | | | | | | | | | | | | | | | |
| 1052 | 1110 | B1.0|REF99_V4|108549 | 1077 | B1.0|REF99_V4|4209 | | | | | | | | | | | | | | | | | | | |
| 1057 | 1099 | B1.0|REF99_V4|11708 | 1093 | B1.0|REF99_V4|429 | | | | | | | | | | | | | | | | | | | |
| 1066 | 648 | B1.0|REF99_V4|414 | 881 | B1.0|REF99_V4|4434 | | | | | | | | | | | | | | | | | | | |
| 1070 | 1097 | B1.0|REF99_V4|159716 | 1093 | B1.0|REF99_V4|429 | | | | | | | | 39 | 50 | 29 | 12 | | | | | 32 | 46 | 28 | 12 |
| 1071 | 1077 | B1.0|REF99_V4|159716 | 1113 | B1.0|REF99_V4|52497 | | | | | | | | 39 | 30 | 29 | 7 | | | | | 32 | 30 | 29 | 8 |
| 1080 | 1097 | B1.0|REF99_V4|4209 | 1093 | B1.0|REF99_V4|429 | | | | | | | | 38 | 65 | 36 | 15 | | | | | 38 | 64 | 36 | 20 |
| 1083 | 972 | B1.0|REF99_V4|4218 | 960 | B1.0|REF99_V4|4684 | | | | | | | | | | | | | | | | 31 | 43 | 24 | 11 |
| 1086 | 1086 | B1.0|REF99_V4|25794 | 1113 | B1.0|REF99_V4|52497 | | | | | | | | 30 | 44 | 29 | 8 | | | | | 46 | 48 | 31 | 18 |
| 1091 | 1093 | B1.0|REF99_V4|429 | 1113 | B1.0|REF99_V4|52497 | | | | | | | | 30 | 25 | 22 | 5 | | | | | 30 | 43 | 29 | 11 |
| 1102 | 960 | B1.0|REF99_V4|4684 | 1113 | B1.0|REF99_V4|52497 | | | | | | | | 65 | 44 | 38 | 18 | | | | | 30 | 25 | 22 | 6 |
| 1125 | 1011 | B1.0|REF97_V4|2104 | 957 | B1.0|REF99_V4|4921 | | | | | | | | 44 | 25 | 24 | 7 | | | | | 64 | 43 | 38 | 22 |
| 1130 | 1011 | B1.0|REF97_V4|2104 | 137 | B1.0|REF99_V4|411 | | | | | | | | 26 | 60 | 26 | 10 | | | | | 63 | 33 | 31 | 17 |
| 1141 | 1011 | B1.0|REF97_V4|2104 | 71 | B1.0|REF99_V4|41351 | | | | | | | | 26 | 32 | 22 | 5 | | | | | 47 | 25 | 23 | 10 |
| 1142 | 1011 | B1.0|REF97_V4|2104 | 943 | B1.0|REF99_V4|426030 | | | | | | | | 26 | 32 | 22 | 5 | | | | | 43 | 25 | 24 | 9 |
| 1143 | 1011 | B1.0|REF97_V4|2104 | 615 | B1.0|REF99_V4|43374 | | | | | | | | 26 | 30 | 21 | 5 | | | | | 33 | 46 | 25 | 12 |
| 1147 | 1011 | B1.0|REF97_V4|2104 | 963 | B1.0|REF99_V4|433855 | | | | | | | | 26 | 31 | 23 | 5 | | | | | | | | |
| 1159 | 974 | B1.0|REF97_V4|42831 | 69 | B1.0|REF99_V4|4506 | | | | | | | | 37 | 22 | 22 | 5 | | | | | | | | |
| 1232 | 837 | B1.0|REF97_V4|4720 | 529 | B1.0|REF99_V4|43983 | | | | | | | | 32 | 33 | 23 | 7 | | | | | | | | |
| 1239 | 1007 | B1.0|REF99_V4|49526 | 739 | B1.0|REF99_V4|41562 | | | | | | | | | | | | | | | | | | | |
| 1248 | 1007 | B1.0|REF99_V4|49526 | 734 | B1.0|REF99_V4|4558 | | | | | | | | | | | | | | | | | | | |
| 1344 | 892 | B1.0|REF99_V4|41177 | 945 | B1.0|REF99_V4|4442 | | | | | | | | | | | | 22 | 25 | 19 | 15 | | | | |
| 1352 | 892 | B1.0|REF99_V4|41177 | 353 | B1.0|REF99_V4|49861 | | | | | | | | | | | | 22 | 20 | 16 | 12 | | | | |
| 1376 | 939 | B1.0|REF99_V4|41317 | 739 | B1.0|REF99_V4|41562 | | | | | | | | | | | | 18 | 19 | 13 | 9 | | | | |
| 1392 | 939 | B1.0|REF99_V4|41317 | 353 | B1.0|REF99_V4|49861 | | | | | | | | | | | | 18 | 18 | 13 | 9 | | | | |
| 1393 | 939 | B1.0|REF99_V4|41317 | 739 | B1.0|REF99_V4|41562 | | | | | | | | | | | | 19 | 25 | 18 | 13 | | | | |
| 1395 | 71 | B1.0|REF99_V4|41351 | 653 | B1.0|REF99_V4|4995 | | | | | | | | 32 | 25 | 21 | 5 | 19 | 18 | 13 | 9 | | | | |
| 1397 | 71 | B1.0|REF99_V4|41351 | 1180 | B1.0|REF99_V4|4166 | | | | | | | | 32 | 51 | 27 | 10 | 19 | 21 | 15 | 11 | | | | |
| 1417 | 1013 | B1.0|REF99_V4|13951 | 945 | B1.0|REF99_V4|4442 | | | | | | | | | | | | 17 | 19 | 13 | 9 | | | | |
| 1428 | 648 | B1.0|REF99_V4|414 | 656 | B1.0|REF99_V4|4191 | | | | | | | | 83 | 42 | 38 | 22 | | | | | | | | |

TABLE 12-continued

| A | B | C | D | E | F Bacteria - cultivated | | | | G Bacteria - cultivated, roots | | | | H Bacteria - cultivated, seeds | | | | I Bacteria - wild | | | | J Bacteria - wild, roots | | | | K Bacteria - wild, seeds | | | |
|---|---|---|---|---|---|---|---|---|---|---|---|---|---|---|---|---|---|---|---|---|---|---|---|---|---|---|---|---|---|
| PAIR | 1 (SEQ ID NO:) | Endophyte 1 (OTU) | Endophyte 2 (SEQ ID NO:) | Endophyte 2 (OTU) | N1 | N2 | OC | EC | N1 | N2 | OC | EC | N1 | N2 | OC | EC | N1 | N2 | OC | EC | N1 | N2 | OC | EC | N1 | N2 | OC | EC |
| 1451 | 739 | B1.0|REF99_V4|1562 | 1011 | B1.0|REF99_V4|2104 | | | | | | | | | | | | | 25 | 32 | 22 | 5 | | | | | | | | |
| 1452 | 739 | B1.0|REF99_V4|1562 | 789 | B1.0|REF99_V4|2172 | | | | | | | | | | | | | 25 | 51 | 24 | 8 | | | | | | | | |
| 1456 | 739 | B1.0|REF99_V4|1562 | 943 | B1.0|REF99_V4|26030 | | | | | | | | | | | | | 25 | 30 | 21 | 5 | | | | | | | | |
| 1457 | 739 | B1.0|REF99_V4|1562 | 615 | B1.0|REF99_V4|3374 | | | | | | | | | | | | | 25 | 33 | 22 | 5 | | | | | | | | |
| 1462 | 739 | B1.0|REF99_V4|1562 | 69 | B1.0|REF99_V4|506 | | | | | | | | | | | | | 25 | 33 | 23 | 5 | | | | | | | | |
| 1464 | 739 | B1.0|REF99_V4|1562 | 713 | B1.0|REF99_V4|754 | | | | | | | | | | | | | 25 | 37 | 22 | 6 | | | | | | | | |
| 1465 | 739 | B1.0|REF99_V4|1562 | 915 | B1.0|REF99_V4|884 | | | | | | | | | | | | | 25 | 28 | 21 | 4 | | | | | | | | |
| 1470 | 116 | B1.0|REF99_V4|1562 | 656 | B1.0|REF99_V4|191 | | | | | | | | | | | | | 32 | 42 | 26 | 8 | | | | | | | | |
| 1480 | 1180 | B1.0|REF99_V4|166 | 1011 | B1.0|REF99_V4|2104 | | | | | | | | | | | | | 51 | 32 | 27 | 10 | | | | | | | | |
| 1485 | 1180 | B1.0|REF99_V4|166 | 615 | B1.0|REF99_V4|3374 | | | | | | | | | | | | | 51 | 30 | 26 | 10 | | | | | | | | |
| 1490 | 1180 | B1.0|REF99_V4|166 | 69 | B1.0|REF99_V4|506 | | | | | | | | | | | | | 51 | 33 | 27 | 11 | | | | | | | | |
| 1527 | 656 | B1.0|REF99_V4|191 | 1011 | B1.0|REF99_V4|2104 | | | | | | | | | | | | | 42 | 32 | 26 | 8 | | | | | | | | |
| 1529 | 656 | B1.0|REF99_V4|191 | 943 | B1.0|REF99_V4|26030 | | | | | | | | | | | | | 42 | 32 | 26 | 8 | | | | | | | | |
| 1533 | 656 | B1.0|REF99_V4|191 | 69 | B1.0|REF99_V4|506 | | | | | | | | | | | | | 42 | 33 | 28 | 9 | | | | | | | | |
| 1564 | 613 | B1.0|REF99_V4|2200 | 681 | B1.0|REF99_V4|234 | | | | | | | | | | | | | | | | | 17 | 20 | 13 | 9 | | | | |
| 1565 | 613 | B1.0|REF99_V4|2200 | 683 | B1.0|REF99_V4|2385 | | | | | | | | | | | | | | | | | 17 | 20 | 13 | 9 | | | | |
| 1574 | 613 | B1.0|REF99_V4|2200 | 353 | B1.0|REF99_V4|49861 | | | | | | | | | | | | | | | | | 17 | 18 | 12 | 8 | | | | |
| 1590 | 683 | B1.0|REF99_V4|2385 | 961 | B1.0|REF99_V4|43580 | | | | | | | | | | | | | | | | | 20 | 21 | 16 | 11 | | | | |
| 1593 | 683 | B1.0|REF99_V4|2385 | 853 | B1.0|REF99_V4|45965 | | | | | | | | | | | | | | | | | 20 | 14 | 12 | 8 | | | | |
| 1606 | 131 | B1.0|REF99_V4|251 | 69 | B1.0|REF99_V4|506 | | | | | | | | | | | | | 30 | 33 | 23 | 6 | | | | | | | | |
| 1626 | 943 | B1.0|REF99_V4|26030 | 529 | B1.0|REF99_V4|3983 | | | | | | | | | | | | | 32 | 22 | 21 | 4 | | | | | | | | |
| 1635 | 974 | B1.0|REF99_V4|2831 | 529 | B1.0|REF99_V4|3983 | | | | | | | | | | | | | 37 | 22 | 22 | 5 | | | | | | | | |
| 1652 | 963 | B1.0|REF99_V4|33855 | 69 | B1.0|REF99_V4|506 | | | | | | | | | | | | | 31 | 33 | 24 | 6 | | | | | | | | |
| 1668 | 916 | B1.0|REF99_V4|3675 | 529 | B1.0|REF99_V4|3983 | | | | | | | | | | | | | 37 | 22 | 22 | 5 | | | | | | | | |
| 1709 | 853 | B1.0|REF99_V4|45965 | 319 | B1.0|REF99_V4|70731 | | | | | | | | | | | | | | | | | 14 | 21 | 12 | 8 | | | | |
| 1724 | 319 | B1.0|REF99_V4|70731 | 353 | B1.0|REF99_V4|49861 | | | | | | | | | | | | | | | | | 21 | 18 | 14 | 10 | | | | |
| 1725 | 319 | B1.0|REF99_V4|70731 | 653 | B1.0|REF99_V4|4995 | | | | | | | | | | | | | | | | | 21 | 21 | 16 | 12 | | | | |
| 1737 | 968 | B1.0|REF99_V4|4972 | 353 | B1.0|REF99_V4|49861 | | | | | | | | | | | | | | | | | 11 | 17 | 10 | 6 | | | | |
| 1745 | 1180 | B1.0|REF99_V4|166 | 1013 | B1.0|REF99_V4|13951 | | | | | | | | | | | | | | | | | 19 | 14 | 12 | 5 | | | | |
| 1749 | 1180 | B1.0|REF99_V4|166 | 613 | B1.0|REF99_V4|2200 | | | | | | | | | | | | | | | | | 17 | 20 | 13 | 9 | | | | |
| 1760 | 681 | B1.0|REF97_V4|234 | 683 | B1.0|REF99_V4|2385 | | | | | | | | | | | | | | | | | 20 | 20 | 15 | 11 | | | | |
| 1827 | 683 | B1.0|REF97_V4|166 | 818 | B1.0|REF99_V4|531 | | | | | | | | | | | | | | | | | 20 | 17 | 15 | 9 | | | | |
| 1888 | 916 | B1.0|REF97_V4|3675 | 529 | B1.0|REF99_V4|3983 | | | | | | | | | | | | | 33 | 22 | 21 | 5 | | | | | | | | |
| 1971 | 944 | B1.0|REF99_V4|101700 | 353 | B1.0|REF99_V4|49861 | | | | | | | | | | | | | | | | | 10 | 18 | 9 | 5 | | | | |
| 1987 | 121 | B1.0|REF99_V4|1211 | 818 | B1.0|REF99_V4|531 | | | | | | | | | | | | | | | | | 18 | 17 | 12 | 8 | | | | |
| 1988 | 939 | B1.0|REF99_V4|1317 | 388 | B1.0|REF99_V4|45893 | | | | | | | | | | | | | | | | | 19 | 11 | 10 | 6 | | | | |
| 2008 | 939 | B1.0|REF99_V4|1317 | 853 | B1.0|REF99_V4|45965 | | | | | | | | | | | | | | | | | 19 | 14 | 12 | 7 | | | | |
| 2122 | 1180 | B1.0|REF99_V4|13951 | 683 | B1.0|REF99_V4|2385 | | | | | | | | | | | | | | | | | 17 | 20 | 13 | 9 | | | | |
| 2140 | 681 | B1.0|REF99_V4|234 | 683 | B1.0|REF99_V4|2385 | | | | | | | | | | | | | | | | | 20 | 20 | 15 | 11 | | | | |
| 2200 | 683 | B1.0|REF99_V4|2385 | 818 | B1.0|REF99_V4|531 | | | | | | | | | | | | | | | | | 20 | 17 | 15 | 9 | | | | |
| 2351 | 529 | B1.0|REF99_V4|3983 | 1012 | B1.0|REF99_V4|597 | | | | | | | | | | | | | 22 | 34 | 22 | 5 | | | | | 29 | 52 | 25 | 12 |
| 2399 | 1159 | B1.0|REF99_V4|4138 | 826 | B1.0|REF99_V4|467 | | | | | | | | | | | | | 35 | 52 | 33 | 11 | | | | | 35 | 52 | 33 | 15 |
| 2430 | 717 | B1.0|REF99_V4|17223 | 826 | B1.0|REF99_V4|467 | | | | | | | | | | | | | | | | | | | | | 26 | 52 | 24 | 11 |
| 2452 | 105 | B1.0|REF99_V4|2738 | 1199 | B1.0|REF99_V4|589 | | | | | | | | | | | | | 52 | 39 | 32 | 13 | | | | | 52 | 39 | 32 | 17 |
| 2455 | 826 | B1.0|REF99_V4|467 | 1134 | B1.0|REF99_V4|986 | | | | | | | | | | | | | 52 | 51 | 33 | 17 | | | | | 52 | 41 | 33 | 17 |
| 2574 | 1191 | B1.0|REF99_V4|150716 | 804 | B1.0|REF99_V4|1838 | | | | | | | | | | | | | 50 | 29 | 26 | 9 | | | | | 50 | 29 | 26 | 12 |

TABLE 12-continued

| A | B | C | D | E | F Bacteria - cultivated | | | | G Bacteria - cultivated, roots | | | | H Bacteria - cultivated, seeds | | | | I Bacteria - wild | | | | J Bacteria - wild, roots | | | | K Bacteria - wild, seeds | | | |
|---|---|---|---|---|---|---|---|---|---|---|---|---|---|---|---|---|---|---|---|---|---|---|---|---|---|---|---|---|
| PAIR | Endophyte 1 (SEQ ID NO:) | Endophyte 1 (OTU) | Endophyte 2 (SEQ ID NO:) | Endophyte 2 (OTU) | N1 | N2 | OC | EC | N1 | N2 | OC | EC | N1 | N2 | OC | EC | N1 | N2 | OC | EC | N1 | N2 | OC | EC | N1 | N2 | OC | EC |
| 2576 | 1191 | B1.0\|REF97_V4\|150716 | 816 | B1.0\|REF99_V4\|21134 | | | | | | | | | | | | | | | | | | | | | 50 | 26 | 23 | 11 |
| 2595 | 1180 | B1.0\|REF97_V4\|166 | 683 | B1.0\|REF99_V4\|42385 | | | | | | | | | | | | | | | | | | | | | | | | |
| 2607 | 313 | B1.0\|REF97_V4\|18024 | 864 | B1.0\|REF99_V4\|4217 | | | | | | | | | | | | | | | | | 11 | 20 | 10 | 6 | | | | |
| 2711 | 670 | B1.0\|REF97_V4\|10019 | 332 | B1.0\|REF99_V4\|10068 | | | | | | | | | | | | | | | | | 16 | 12 | 9 | 5 | | | | |
| 2935 | 804 | B1.0\|REF97_V4\|1838 | 907 | B1.0\|REF99_V4\|44661 | | | | | | | | | | | | | | | | | 7 | 17 | 7 | 3 | | | | |
| 3090 | 1106 | B1.0\|REF97_V4\|466 | 1090 | B1.0\|REF99_V4\|79117 | | | | | | | | | | | | | | | | | 22 | 11 | 11 | 7 | 29 | 22 | 19 | 5 |
| 3116 | 1110 | B1.0\|REF97_V4\|108549 | 1091 | B1.0\|REF99_V4\|415 | | | | | | | | | | | | | 38 | 50 | 30 | 12 | | | | | 38 | 46 | 30 | 14 |
| 3118 | 1099 | B1.0\|REF97_V4\|11708 | 1091 | B1.0\|REF99_V4\|415 | | | | | | | | | | | | | 31 | 50 | 27 | 10 | | | | | 31 | 46 | 27 | 12 |
| 3121 | 1091 | B1.0\|REF99_V4\|415 | 1081 | B1.0\|REF99_V4\|156009 | | | | | | | | | | | | | 50 | 45 | 32 | 14 | | | | | 46 | 45 | 32 | 11 |
| 3122 | 1091 | B1.0\|REF99_V4\|415 | 1097 | B1.0\|REF99_V4\|159716 | | | | | | | | | | | | | | | | | | | | | 46 | 30 | 25 | 11 |
| 3124 | 1081 | B1.0\|REF99_V4\|156009 | 1097 | B1.0\|REF99_V4\|159716 | | | | | | | | | | | | | 45 | 30 | 30 | 8 | | | | | 45 | 30 | 30 | 11 |
| 3125 | 1081 | B1.0\|REF99_V4\|156009 | 1080 | B1.0\|REF99_V4\|419 | | | | | | | | | | | | | 45 | 39 | 33 | 11 | | | | | 45 | 38 | 33 | 14 |
| 3127 | 1097 | B1.0\|REF99_V4\|159716 | 1080 | B1.0\|REF99_V4\|419 | | | | | | | | | | | | | 30 | 39 | 30 | 7 | | | | | 30 | 38 | 30 | 9 |
| 3131 | 1108 | B1.0\|REF97_V4\|41 | 1081 | B1.0\|REF99_V4\|156009 | | | | | | | | | | | | | 39 | 45 | 32 | 11 | | | | | 32 | 45 | 32 | 12 |
| 3136 | 850 | B1.0\|REF99_V4\|11157 | 684 | B1.0\|REF99_V4\|4172 | | | | | | | | | | | | | | | | | | | | | 39 | 60 | 34 | 19 |
| 3156 | 1191 | B1.0\|REF97_V4\|150716 | 1175 | B1.0\|REF99_V4\|4284 | | | | | | | | | | | | | 50 | 55 | 37 | 17 | | | | | 50 | 51 | 37 | 21 |
| 3181 | 1158 | B1.0\|REF97_V4\|41323 | 1158 | B1.0\|REF99_V4\|41323 | | | | | | | | | | | | | 39 | 82 | 38 | 20 | | | | | 33 | 66 | 32 | 18 |
| 3182 | 1191 | B1.0\|REF97_V4\|150716 | 850 | B1.0\|REF99_V4\|11157 | | | | | | | | | | | | | 50 | 46 | 32 | 14 | | | | | 50 | 39 | 32 | 16 |
| 3183 | 1191 | B1.0\|REF97_V4\|150716 | 800 | B1.0\|REF99_V4\|156812 | | | | | | | | | | | | | 50 | 37 | 32 | 12 | | | | | 50 | 30 | 32 | 15 |
| 3185 | 850 | B1.0\|REF99_V4\|11157 | 1191 | B1.0\|REF99_V4\|150716 | | | | | | | | | | | | | | | | | | | | | 39 | 37 | 31 | 17 |
| 3186 | 850 | B1.0\|REF99_V4\|11157 | 852 | B1.0\|REF99_V4\|4298 | | | | | | | | | | | | | | | | | | | | | 39 | 53 | 23 | 10 |
| 3187 | 111 | B1.0\|REF99_V4\|1256 | 1191 | B1.0\|REF99_V4\|150716 | | | | | | | | | | | | | 44 | 53 | 34 | 15 | | | | | 44 | 53 | 34 | 19 |
| 3188 | 1191 | B1.0\|REF97_V4\|150716 | 1175 | B1.0\|REF99_V4\|4284 | | | | | | | | | | | | | 53 | 55 | 38 | 18 | | | | | 53 | 51 | 38 | 22 |
| 3189 | 1081 | B1.0\|REF99_V4\|156009 | 1113 | B1.0\|REF99_V4\|452497 | | | | | | | | | | | | | 45 | 25 | 24 | 7 | | | | | 45 | 25 | 24 | 9 |
| 3190 | 800 | B1.0\|REF99_V4\|156812 | 852 | B1.0\|REF99_V4\|4298 | | | | | | | | | | | | | 37 | 30 | 26 | 7 | | | | | 37 | 30 | 26 | 9 |
| 3191 | 717 | B1.0\|REF99_V4\|17223 | 1199 | B1.0\|REF99_V4\|4589 | | | | | | | | | | | | | 35 | 39 | 28 | 9 | | | | | 35 | 39 | 28 | 11 |
| 3192 | 1080 | B1.0\|REF99_V4\|419 | 1092 | B1.0\|REF99_V4\|476 | | | | | | | | | | | | | 39 | 42 | 29 | 10 | | | | | 38 | 38 | 27 | 12 |
| 3193 | 816 | B1.0\|REF99_V4\|21134 | 644 | B1.0\|REF99_V4\|47232 | | | | | | | | | | | | | | | | | | | | | 26 | 28 | 20 | 6 |
| 3194 | 1175 | B1.0\|REF99_V4\|4284 | 957 | B1.0\|REF99_V4\|4921 | | | | | | | | | | | | | 55 | 48 | 35 | 17 | | | | | 51 | 46 | 35 | 19 |
| 3195 | 1092 | B1.0\|REF99_V4\|476 | 1090 | B1.0\|REF99_V4\|79117 | | | | | | | | | | | | | | | | | | | | | 38 | 37 | 24 | 11 |
| 3196 | 510 | B1.0\|REF99_V4\|48981 | 957 | B1.0\|REF99_V4\|4921 | | | | | | | | | | | | | | | | | | | | | 41 | 46 | 29 | 15 |
| 3331 | 1108 | B1.0\|REF97_V4\|41 | 1077 | B1.0\|REF99_V4\|4209 | | | | | | | | | | | | | | | | | | | | | 32 | 64 | 32 | 17 |
| 3332 | 137 | B1.0\|REF97_V4\|411 | 69 | B1.0\|REF99_V4\|4506 | | | | | | | | | | | | | | | | | | | | | | | | |
| 3333 | 137 | B1.0\|REF97_V4\|411 | 915 | B1.0\|REF99_V4\|4884 | | | | | | | | | | | | | | | | | | | | | | | | |
| 3334 | 1191 | B1.0\|REF97_V4\|150716 | 717 | B1.0\|REF99_V4\|17223 | | | | | | | | | | | | | 39 | 65 | 33 | 16 | | | | | 50 | 35 | 28 | 14 |
| 3335 | 1191 | B1.0\|REF97_V4\|150716 | 826 | B1.0\|REF99_V4\|1467 | | | | | | | | | | | | | 32 | 33 | 24 | 7 | | | | | 50 | 52 | 36 | 21 |
| 3336 | 1191 | B1.0\|REF97_V4\|150716 | 1199 | B1.0\|REF99_V4\|4589 | | | | | | | | | | | | | 32 | 28 | 22 | 6 | | | | | 50 | 30 | 30 | 16 |
| 3337 | 1191 | B1.0\|REF97_V4\|150716 | 644 | B1.0\|REF99_V4\|47232 | | | | | | | | | | | | | 50 | 35 | 28 | 11 | | | | | 50 | 39 | 25 | 11 |
| 3338 | 850 | B1.0\|REF99_V4\|11157 | 111 | B1.0\|REF99_V4\|41256 | | | | | | | | | | | | | 50 | 52 | 36 | 16 | | | | | 39 | 44 | 29 | 14 |
| 3339 | 850 | B1.0\|REF99_V4\|11157 | 826 | B1.0\|REF99_V4\|1467 | | | | | | | | | | | | | 50 | 39 | 32 | 12 | | | | | 50 | 28 | 25 | 11 |
| 3340 | 764 | B1.0\|REF99_V4\|121771 | 717 | B1.0\|REF99_V4\|17223 | | | | | | | | | | | | | 50 | 28 | 25 | 9 | | | | | 46 | 52 | 31 | 17 |
| 3341 | 764 | B1.0\|REF99_V4\|121771 | 643 | B1.0\|REF99_V4\|1176246 | | | | | | | | | | | | | 46 | 44 | 29 | 13 | | | | | 23 | 35 | 21 | 7 |
| 3342 | 764 | B1.0\|REF99_V4\|121771 | 824 | B1.0\|REF99_V4\|1211723 | | | | | | | | | | | | | 46 | 35 | 31 | 15 | | | | | 23 | 21 | 20 | 4 |
| 3343 | 764 | B1.0\|REF99_V4\|121771 | 852 | B1.0\|REF99_V4\|4298 | | | | | | | | | | | | | 23 | 23 | 21 | 5 | | | | | 23 | 22 | 20 | 4 |
| 3344 | 764 | B1.0\|REF99_V4\|121771 | 1241 | B1.0\|REF99_V4\|4511 | | | | | | | | | | | | | 23 | 23 | 20 | 3 | | | | | 23 | 30 | 21 | 6 |
| 3345 | 764 | B1.0\|REF99_V4\|121771 | 644 | B1.0\|REF99_V4\|47232 | | | | | | | | | | | | | 23 | 22 | 20 | 3 | | | | | 23 | 28 | 20 | 5 |

TABLE 12-continued

| PAIR | B Endophyte 1 (SEQ ID NO:) | C Endophyte 1 (OTU) | D Endophyte 2 (SEQ ID NO:) | E Endophyte 2 (OTU) | F Bacteria - cultivated | | | | G Bacteria - cultivated, roots | | | | H Bacteria - cultivated, seeds | | | | I Bacteria - wild | | | | J Bacteria - wild, roots | | | | K Bacteria - wild, seeds | | | |
|---|---|---|---|---|---|---|---|---|---|---|---|---|---|---|---|---|---|---|---|---|---|---|---|---|---|---|---|---|
| | | | | | N1 | N2 | OC | EC | N1 | N2 | OC | EC | N1 | N2 | OC | EC | N1 | N2 | OC | EC | N1 | N2 | OC | EC | N1 | N2 | OC | EC |
| 3346 | 111 | B1.0iREF99_V4\|1256 | 84 | B1.0iREF99_V4\|13862 | | | | | | | | | | | | | 44 | 25 | 23 | 7 | | | | | 44 | 25 | 23 | 9 |
| 3347 | 111 | B1.0iREF99_V4\|1256 | 800 | B1.0iREF99_V4\|156812 | | | | | | | | | | | | | 44 | 37 | 27 | 10 | | | | | 44 | 37 | 27 | 13 |
| 3348 | 111 | B1.0iREF99_V4\|1256 | 717 | B1.0iREF99_V4\|17223 | | | | | | | | | | | | | 44 | 35 | 27 | 10 | | | | | 44 | 35 | 27 | 13 |
| 3349 | 111 | B1.0iREF99_V4\|1256 | 804 | B1.0iREF99_V4\|1838 | | | | | | | | | | | | | 44 | 29 | 24 | 8 | | | | | 44 | 29 | 24 | 10 |
| 3350 | 111 | B1.0iREF99_V4\|1256 | 105 | B1.0iREF99_V4\|2738 | | | | | | | | | | | | | 44 | 26 | 24 | 7 | | | | | 44 | 26 | 24 | 9 |
| 3351 | 111 | B1.0iREF99_V4\|1256 | 826 | B1.0iREF99_V4\|467 | | | | | | | | | | | | | 44 | 52 | 34 | 14 | | | | | 44 | 52 | 34 | 19 |
| 3352 | 111 | B1.0iREF99_V4\|1256 | 957 | B1.0iREF99_V4\|921 | | | | | | | | | | | | | 44 | 48 | 30 | 13 | | | | | 44 | 46 | 30 | 17 |
| 3353 | 953 | B1.0iREF99_V4\|12728 | 265 | B1.0iREF99_V4\|190866 | | | | | | | | | | | | | 25 | 22 | 20 | 3 | | | | | 25 | 22 | 20 | 5 |
| 3354 | 1159 | B1.0iREF99_V4\|138 | 1175 | B1.0iREF99_V4\|284 | | | | | | | | | | | | | 32 | 55 | 27 | 11 | | | | | 29 | 51 | 25 | 12 |
| 3355 | 84 | B1.0iREF99_V4\|13862 | 800 | B1.0iREF99_V4\|156812 | | | | | | | | | | | | | 25 | 37 | 22 | 6 | | | | | 25 | 37 | 22 | 8 |
| 3356 | 84 | B1.0iREF99_V4\|13862 | 852 | B1.0iREF99_V4\|298 | | | | | | | | | | | | | 25 | 30 | 21 | 5 | | | | | 25 | 30 | 21 | 6 |
| 3357 | 1191 | B1.0iREF99_V4\|150716 | 800 | B1.0iREF99_V4\|156812 | | | | | | | | | | | | | 53 | 37 | 31 | 12 | | | | | 53 | 37 | 31 | 16 |
| 3358 | 1191 | B1.0iREF99_V4\|150716 | 717 | B1.0iREF99_V4\|17223 | | | | | | | | | | | | | 53 | 35 | 28 | 12 | | | | | 53 | 35 | 28 | 15 |
| 3359 | 1191 | B1.0iREF99_V4\|150716 | 1109 | B1.0iREF99_V4\|25629 | | | | | | | | | | | | | 53 | 81 | 43 | 27 | | | | | | | | |
| 3360 | 1191 | B1.0iREF99_V4\|150716 | 826 | B1.0iREF99_V4\|467 | | | | | | | | | | | | | 53 | 52 | 38 | 17 | | | | | 53 | 52 | 38 | 22 |
| 3361 | 1191 | B1.0iREF99_V4\|150716 | 1199 | B1.0iREF99_V4\|589 | | | | | | | | | | | | | 53 | 39 | 32 | 13 | | | | | 53 | 39 | 32 | 17 |
| 3362 | 800 | B1.0iREF99_V4\|156812 | 644 | B1.0iREF99_V4\|7232 | | | | | | | | | | | | | 53 | 28 | 26 | 9 | | | | | 53 | 28 | 26 | 12 |
| 3363 | 800 | B1.0iREF99_V4\|156812 | 717 | B1.0iREF99_V4\|17223 | | | | | | | | | | | | | 37 | 35 | 25 | 8 | | | | | 37 | 35 | 25 | 11 |
| 3364 | 800 | B1.0iREF99_V4\|156812 | 804 | B1.0iREF99_V4\|1838 | | | | | | | | | | | | | 37 | 29 | 23 | 7 | | | | | 37 | 29 | 23 | 9 |
| 3365 | 800 | B1.0iREF99_V4\|156812 | 1175 | B1.0iREF99_V4\|284 | | | | | | | | | | | | | 37 | 55 | 32 | 13 | | | | | 37 | 51 | 32 | 15 |
| 3366 | 800 | B1.0iREF99_V4\|156812 | 826 | B1.0iREF99_V4\|467 | | | | | | | | | | | | | 37 | 52 | 31 | 12 | | | | | 37 | 52 | 31 | 16 |
| 3367 | 800 | B1.0iREF99_V4\|156812 | 702 | B1.0iREF99_V4\|45579 | | | | | | | | | | | | | 37 | 42 | 26 | 10 | | | | | 37 | 42 | 26 | 13 |
| 3368 | 800 | B1.0iREF99_V4\|156812 | 1199 | B1.0iREF99_V4\|589 | | | | | | | | | | | | | 37 | 39 | 27 | 9 | | | | | 37 | 39 | 27 | 12 |
| 3369 | 800 | B1.0iREF99_V4\|156812 | 957 | B1.0iREF99_V4\|921 | | | | | | | | | | | | | 37 | 48 | 28 | 11 | | | | | 37 | 46 | 28 | 14 |
| 3370 | 1097 | B1.0iREF99_V4\|159716 | 1077 | B1.0iREF99_V4\|209 | | | | | | | | | | | | | 30 | 65 | 30 | 12 | | | | | 30 | 64 | 30 | 16 |
| 3371 | 1088 | B1.0iREF99_V4\|1703 | 1163 | B1.0iREF99_V4\|174886 | | | | | | | | | | | | | 75 | 55 | 45 | 26 | | | | | | | | |
| 3372 | 717 | B1.0iREF99_V4\|17223 | 721 | B1.0iREF99_V4\|176246 | | | | | | | | | | | | | 35 | 21 | 21 | 5 | | | | | 35 | 21 | 21 | 6 |
| 3373 | 717 | B1.0iREF99_V4\|17223 | 643 | B1.0iREF99_V4\|1838 | | | | | | | | | | | | | 35 | 21 | 21 | 5 | | | | | 35 | 21 | 21 | 6 |
| 3374 | 717 | B1.0iREF99_V4\|17223 | 804 | B1.0iREF99_V4\|1838 | | | | | | | | | | | | | 35 | 29 | 24 | 6 | | | | | 35 | 29 | 24 | 8 |
| 3375 | 717 | B1.0iREF99_V4\|17223 | 824 | B1.0iREF99_V4\|211723 | | | | | | | | | | | | | 35 | 22 | 21 | 5 | | | | | 35 | 22 | 21 | 6 |
| 3376 | 717 | B1.0iREF99_V4\|17223 | 1175 | B1.0iREF99_V4\|284 | | | | | | | | | | | | | 35 | 55 | 31 | 12 | | | | | 35 | 51 | 31 | 15 |
| 3377 | 717 | B1.0iREF99_V4\|17223 | 852 | B1.0iREF99_V4\|298 | | | | | | | | | | | | | 35 | 30 | 23 | 7 | | | | | 35 | 30 | 23 | 9 |
| 3378 | 717 | B1.0iREF99_V4\|17223 | 701 | B1.0iREF99_V4\|43785 | | | | | | | | | | | | | 35 | 23 | 21 | 5 | | | | | 35 | 22 | 21 | 6 |
| 3379 | 804 | B1.0iREF99_V4\|1838 | 824 | B1.0iREF99_V4\|211723 | | | | | | | | | | | | | 29 | 22 | 20 | 4 | | | | | 29 | 22 | 20 | 5 |
| 3380 | 804 | B1.0iREF99_V4\|1838 | 852 | B1.0iREF99_V4\|298 | | | | | | | | | | | | | 29 | 30 | 22 | 5 | | | | | 29 | 30 | 22 | 7 |
| 3381 | 804 | B1.0iREF99_V4\|1838 | 957 | B1.0iREF99_V4\|921 | | | | | | | | | | | | | 29 | 48 | 25 | 9 | | | | | 29 | 46 | 25 | 11 |
| 3382 | 1080 | B1.0iREF99_V4\|19 | 1113 | B1.0iREF99_V4\|52497 | | | | | | | | | | | | | 39 | 25 | 23 | 6 | | | | | 38 | 25 | 23 | 8 |
| 3383 | 763 | B1.0iREF99_V4\|197072 | 852 | B1.0iREF99_V4\|298 | | | | | | | | | | | | | 21 | 30 | 20 | 4 | | | | | 21 | 30 | 20 | 5 |
| 3384 | 816 | B1.0iREF99_V4\|21134 | 852 | B1.0iREF99_V4\|298 | | | | | | | | | | | | | 26 | 30 | 21 | 5 | | | | | 26 | 30 | 21 | 6 |
| 3385 | 816 | B1.0iREF99_V4\|21134 | 854 | B1.0iREF99_V4\|468277 | | | | | | | | | | | | | 26 | 23 | 21 | 4 | | | | | 26 | 23 | 21 | 5 |
| 3386 | 972 | B1.0iREF99_V4\|218 | 1109 | B1.0iREF99_V4\|25629 | | | | | | | | | | | | | 63 | 81 | 49 | 32 | | | | | | | | |
| 3387 | 972 | B1.0iREF99_V4\|218 | 826 | B1.0iREF99_V4\|467 | | | | | | | | | | | | | 63 | 52 | 38 | 21 | | | | | | | | |
| 3388 | 1109 | B1.0iREF99_V4\|25629 | 1163 | B1.0iREF99_V4\|46806 | | | | | | | | | | | | | 81 | 55 | 45 | 28 | | | | | | | | |
| 3389 | 105 | B1.0iREF99_V4\|2738 | 852 | B1.0iREF99_V4\|298 | | | | | | | | | | | | | 26 | 30 | 22 | 5 | | | | | 26 | 30 | 22 | 6 |
| 3390 | 1175 | B1.0iREF99_V4\|284 | 702 | B1.0iREF99_V4\|45579 | | | | | | | | | | | | | 55 | 42 | 32 | 14 | | | | | 51 | 42 | 32 | 17 |
| 3391 | 1175 | B1.0iREF99_V4\|284 | 644 | B1.0iREF99_V4\|7232 | | | | | | | | | | | | | 55 | 28 | 26 | 10 | | | | | 51 | 28 | 26 | 12 |

TABLE 12-continued

| PAIR | B Endophyte 1 (SEQ ID NO:) | C Endophyte 1 (OTU) | D Endophyte 2 (SEQ ID NO:) | E Endophyte 2 (OTU) | F Bacteria - cultivated | | | | G Bacteria - cultivated, roots | | | | H Bacteria - cultivated, seeds | | | | I Bacteria - wild | | | | J Bacteria - wild, roots | | | | K Bacteria - wild, seeds | | | |
|---|---|---|---|---|---|---|---|---|---|---|---|---|---|---|---|---|---|---|---|---|---|---|---|---|---|---|---|---|---|
| | | | | | N1 | N2 | OC | EC | N1 | N2 | OC | EC | N1 | N2 | OC | EC | N1 | N2 | OC | EC | N1 | N2 | OC | EC | N1 | N2 | OC | EC |
| 3392 | 852 | B1.0\|REF99_V4\|298 | 826 | B1.0\|REF99_V4\|467 | | | | | | | | | | | | | 30 | 52 | 27 | 10 | | | | | 30 | 52 | 27 | 13 |
| 3393 | 701 | B1.0\|REF99_V4\|3785 | 644 | B1.0\|REF99_V4\|7232 | | | | | | | | | | | | | 23 | 28 | 20 | 4 | | | | | 22 | 28 | 20 | 5 |
| 3394 | 826 | B1.0\|REF99_V4\|467 | 1095 | B1.0\|REF99_V4\|54497 | | | | | | | | | | | | | 52 | 64 | 37 | 21 | | | | | 52 | 42 | 35 | 18 |
| 3395 | 826 | B1.0\|REF99_V4\|467 | 702 | B1.0\|REF99_V4\|5579 | | | | | | | | | | | | | 52 | 42 | 35 | 14 | | | | | 52 | 42 | 35 | 18 |
| 3396 | 826 | B1.0\|REF99_V4\|467 | 957 | B1.0\|REF99_V4\|921 | | | | | | | | | | | | | 52 | 48 | 34 | 16 | | | | | 52 | 46 | 34 | 19 |
| 3397 | 1095 | B1.0\|REF99_V4\|54497 | 1199 | B1.0\|REF99_V4\|589 | | | | | | | | | | | | | 64 | 39 | 32 | 16 | | | | | | | | |
| 3398 | 1095 | B1.0\|REF99_V4\|54497 | 1163 | B1.0\|REF99_V4\|6806 | | | | | | | | | | | | | 64 | 55 | 40 | 22 | | | | | | | | |
| 3399 | 1199 | B1.0\|REF99_V4\|589 | 644 | B1.0\|REF99_V4\|7232 | | | | | | | | | | | | | 39 | 28 | 24 | 7 | | | | | 39 | 28 | 24 | 9 |
| 3400 | 1199 | B1.0\|REF99_V4\|589 | 957 | B1.0\|REF99_V4\|921 | | | | | | | | | | | | | 39 | 48 | 32 | 12 | | | | | 39 | 46 | 32 | 15 |
| 3401 | 1171 | B1.0\|REF99_V4\|234 | 681 | B1.0\|REF99_V4\|234 | | | | | | | | | | | | | | | | | 8 | 20 | 8 | 4 | | | | |
| 3402 | 1171 | B1.0\|REF97_V4\|1639 | 422 | B1.0\|REF99_V4\|5440 | | | | | | | | | | | | | | | | | 8 | 6 | 5 | 1 | | | | |
| 3403 | 313 | B1.0\|REF99_V4\|18024 | 910 | B1.0\|REF99_V4\|2308 | | | | | | | | | | | | | | | | | 16 | 12 | 11 | 5 | | | | |
| 3404 | 615 | B1.0\|REF97_V4\|3374 | 1245 | B1.0\|REF99_V4\|12375 | | | | | | | | | | | | | | | | | 21 | 12 | 11 | 7 | | | | |
| 3405 | 670 | B1.0\|REF99_V4\|10019 | 807 | B1.0\|REF99_V4\|1940 | | | | | | | | | | | | | | | | | 7 | 7 | 5 | 1 | | | | |
| 3406 | 332 | B1.0\|REF99_V4\|10068 | 1248 | B1.0\|REF99_V4\|1792 | | | | | | | | | | | | | | | | | 17 | 13 | 10 | 6 | | | | |
| 3407 | 892 | B1.0\|REF99_V4\|1177 | 1248 | B1.0\|REF99_V4\|1792 | | | | | | | | | | | | | | | | | 18 | 13 | 11 | 6 | | | | |
| 3408 | 121 | B1.0\|REF99_V4\|1211 | 613 | B1.0\|REF99_V4\|2200 | | | | | | | | | | | | | | | | | 18 | 17 | 12 | 8 | | | | |
| 3409 | 1245 | B1.0\|REF99_V4\|12375 | 807 | B1.0\|REF99_V4\|1940 | | | | | | | | | | | | | | | | | 12 | 7 | 6 | 2 | | | | |
| 3410 | 886 | B1.0\|REF99_V4\|1287 | 1171 | B1.0\|REF99_V4\|1639 | | | | | | | | | | | | | | | | | 19 | 22 | 17 | 11 | | | | |
| 3411 | 939 | B1.0\|REF99_V4\|1317 | 1248 | B1.0\|REF99_V4\|1792 | | | | | | | | | | | | | | | | | 19 | 13 | 11 | 7 | | | | |
| 3412 | 939 | B1.0\|REF99_V4\|1317 | 968 | B1.0\|REF99_V4\|972 | | | | | | | | | | | | | | | | | 19 | 13 | 11 | 7 | | | | |
| 3413 | 405 | B1.0\|REF99_V4\|13726 | 910 | B1.0\|REF99_V4\|2308 | | | | | | | | | | | | | | | | | 13 | 12 | 8 | 4 | | | | |
| 3414 | 405 | B1.0\|REF99_V4\|13726 | 422 | B1.0\|REF99_V4\|5440 | | | | | | | | | | | | | | | | | 13 | 6 | 6 | 2 | | | | |
| 3415 | 405 | B1.0\|REF99_V4\|13726 | 734 | B1.0\|REF99_V4\|558 | | | | | | | | | | | | | | | | | 13 | 20 | 11 | 7 | | | | |
| 3416 | 1180 | B1.0\|REF99_V4\|166 | 719 | B1.0\|REF99_V4\|385 | | | | | | | | | | | | | | | | | 30 | 20 | 20 | 16 | | | | |
| 3417 | 1248 | B1.0\|REF99_V4\|1792 | 719 | B1.0\|REF99_V4\|385 | | | | | | | | | | | | | | | | | 13 | 20 | 11 | 7 | | | | |
| 3418 | 1248 | B1.0\|REF99_V4\|1792 | 853 | B1.0\|REF99_V4\|5965 | | | | | | | | | | | | | | | | | 13 | 14 | 9 | 5 | | | | |
| 3419 | 1248 | B1.0\|REF99_V4\|1792 | 968 | B1.0\|REF99_V4\|972 | | | | | | | | | | | | | | | | | 13 | 13 | 9 | 5 | | | | |
| 3420 | 1248 | B1.0\|REF99_V4\|1792 | 353 | B1.0\|REF99_V4\|9861 | | | | | | | | | | | | | | | | | 13 | 18 | 10 | 6 | | | | |
| 3421 | 1248 | B1.0\|REF99_V4\|1792 | 653 | B1.0\|REF99_V4\|995 | | | | | | | | | | | | | | | | | 13 | 21 | 12 | 7 | | | | |
| 3422 | 681 | B1.0\|REF99_V4\|234 | 945 | B1.0\|REF99_V4\|442 | | | | | | | | | | | | | | | | | 20 | 19 | 14 | 10 | | | | |
| 3423 | 810 | B1.0\|REF99_V4\|250 | 529 | B1.0\|REF99_V4\|3983 | | | | | | | | | | | | | | | | | 22 | 22 | 17 | 13 | | | | |
| 3424 | 503 | B1.0\|REF99_V4\|4190 | 945 | B1.0\|REF99_V4\|442 | | | | | | | | | | | | | | | | | 9 | 19 | 9 | 5 | | | | |
| 3425 | 945 | B1.0\|REF99_V4\|442 | 994 | B1.0\|REF99_V4\|8340 | | | | | | | | | | | | | | | | | 19 | 10 | 9 | 5 | | | | |
| 3426 | 1108 | B1.0\|REF97_V4\|41 | 1092 | B1.0\|REF99_V4\|476 | | | | | | | | | | | | | | | | | | | | | 32 | 38 | 23 | 10 |
| 3427 | 1191 | B1.0\|REF99_V4\|150716 | 764 | B1.0\|REF99_V4\|121771 | | | | | | | | | | | | | | | | | | | | | 50 | 23 | 23 | 9 |
| 3428 | 1191 | B1.0\|REF99_V4\|150716 | 84 | B1.0\|REF99_V4\|13862 | | | | | | | | | | | | | | | | | | | | | 50 | 25 | 23 | 10 |
| 3429 | 1191 | B1.0\|REF99_V4\|150716 | 643 | B1.0\|REF99_V4\|176246 | | | | | | | | | | | | | | | | | | | | | 50 | 21 | 21 | 9 |
| 3430 | 1191 | B1.0\|REF99_V4\|150716 | 824 | B1.0\|REF99_V4\|211723 | | | | | | | | | | | | | | | | | | | | | 50 | 22 | 22 | 9 |
| 3431 | 1191 | B1.0\|REF99_V4\|150716 | 852 | B1.0\|REF99_V4\|298 | | | | | | | | | | | | | | | | | | | | | 50 | 30 | 25 | 12 |
| 3432 | 1191 | B1.0\|REF99_V4\|150716 | 719 | B1.0\|REF99_V4\|385 | | | | | | | | | | | | | | | | | | | | | 50 | 45 | 31 | 18 |
| 3433 | 510 | B1.0\|REF97_V4\|8981 | 957 | B1.0\|REF99_V4\|921 | | | | | | | | | | | | | | | | | | | | | 35 | 46 | 26 | 13 |
| 3434 | 1110 | B1.0\|REF99_V4\|108549 | 1092 | B1.0\|REF99_V4\|476 | | | | | | | | | | | | | | | | | | | | | 38 | 38 | 25 | 12 |
| 3435 | 850 | B1.0\|REF99_V4\|11157 | 800 | B1.0\|REF99_V4\|156812 | | | | | | | | | | | | | | | | | | | | | 39 | 37 | 25 | 12 |
| 3436 | 850 | B1.0\|REF99_V4\|11157 | 717 | B1.0\|REF99_V4\|17223 | | | | | | | | | | | | | | | | | | | | | 39 | 35 | 24 | 11 |
| 3437 | 850 | B1.0\|REF99_V4\|11157 | 763 | B1.0\|REF99_V4\|197072 | | | | | | | | | | | | | | | | | | | | | 39 | 21 | 20 | 7 |

TABLE 12-continued

| A | B | C | D | E | F Bacteria - cultivated | | | | G Bacteria - cultivated, roots | | | | H Bacteria - cultivated, seeds | | | | I Bacteria - wild | | | | J Bacteria - wild, roots | | | | K Bacteria - wild, seeds | | | |
|---|---|---|---|---|---|---|---|---|---|---|---|---|---|---|---|---|---|---|---|---|---|---|---|---|---|---|---|---|---|
| PAIR | Endophyte 1 (SEQ ID NO:) | Endophyte 1 (OTU) | Endophyte 2 (SEQ ID NO:) | Endophyte 2 (OTU) | N1 | N2 | OC | EC | N1 | N2 | OC | EC | N1 | N2 | OC | EC | N1 | N2 | OC | EC | N1 | N2 | OC | EC | N1 | N2 | OC | EC |
| 3438 | 850 | B1.0|REF99_V4|11157 | 825 | B1.0|REF99_V4|5606 | | | | | | | | | | | | | | | | | | | | | 39 | 21 | 20 | 7 |
| 3439 | 850 | B1.0|REF99_V4|11157 | 1199 | B1.0|REF99_V4|589 | | | | | | | | | | | | | | | | | | | | | 39 | 39 | 25 | 12 |
| 3440 | 121 | B1.0|REF99_V4|1211 | 111 | B1.0|REF99_V4|1256 | | | | | | | | | | | | | | | | | | | | | 52 | 44 | 31 | 19 |
| 3441 | 121 | B1.0|REF99_V4|1211 | 852 | B1.0|REF99_V4|298 | | | | | | | | | | | | | | | | | | | | | 52 | 30 | 25 | 13 |
| 3442 | 121 | B1.0|REF99_V4|1211 | 719 | B1.0|REF99_V4|385 | | | | | | | | | | | | | | | | | | | | | 52 | 45 | 32 | 19 |
| 3443 | 121 | B1.0|REF99_V4|1211 | 854 | B1.0|REF99_V4|68277 | | | | | | | | | | | | | | | | | | | | | 52 | 23 | 22 | 10 |
| 3444 | 764 | B1.0|REF99_V4|12177 | 111 | B1.0|REF99_V4|1256 | | | | | | | | | | | | | | | | | | | | | 23 | 44 | 22 | 8 |
| 3445 | 764 | B1.0|REF99_V4|12177 | 953 | B1.0|REF99_V4|12728 | | | | | | | | | | | | | | | | | | | | | 23 | 25 | 19 | 5 |
| 3446 | 764 | B1.0|REF99_V4|12177 | 234 | B1.0|REF99_V4|12784 | | | | | | | | | | | | | | | | | | | | | 23 | 25 | 18 | 5 |
| 3447 | 764 | B1.0|REF99_V4|12177 | 1159 | B1.0|REF99_V4|138 | | | | | | | | | | | | | | | | | | | | | 23 | 29 | 18 | 5 |
| 3448 | 764 | B1.0|REF99_V4|12177 | 84 | B1.0|REF99_V4|13862 | | | | | | | | | | | | | | | | | | | | | 23 | 25 | 18 | 5 |
| 3449 | 764 | B1.0|REF99_V4|12177 | 800 | B1.0|REF99_V4|156812 | | | | | | | | | | | | | | | | | | | | | 23 | 37 | 21 | 7 |
| 3450 | 764 | B1.0|REF99_V4|12177 | 721 | B1.0|REF99_V4|174886 | | | | | | | | | | | | | | | | | | | | | 23 | 21 | 18 | 4 |
| 3451 | 764 | B1.0|REF99_V4|12177 | 804 | B1.0|REF99_V4|1838 | | | | | | | | | | | | | | | | | | | | | 23 | 29 | 20 | 5 |
| 3452 | 764 | B1.0|REF99_V4|12177 | 265 | B1.0|REF99_V4|190866 | | | | | | | | | | | | | | | | | | | | | 23 | 22 | 18 | 4 |
| 3453 | 764 | B1.0|REF99_V4|12177 | 816 | B1.0|REF99_V4|21134 | | | | | | | | | | | | | | | | | | | | | 23 | 26 | 19 | 5 |
| 3454 | 764 | B1.0|REF99_V4|12177 | 640 | B1.0|REF99_V4|211419 | | | | | | | | | | | | | | | | | | | | | 23 | 20 | 17 | 4 |
| 3455 | 764 | B1.0|REF99_V4|12177 | 105 | B1.0|REF99_V4|2738 | | | | | | | | | | | | | | | | | | | | | 23 | 26 | 19 | 5 |
| 3456 | 764 | B1.0|REF99_V4|12177 | 1175 | B1.0|REF99_V4|284 | | | | | | | | | | | | | | | | | | | | | 23 | 51 | 22 | 10 |
| 3457 | 764 | B1.0|REF99_V4|12177 | 701 | B1.0|REF99_V4|3785 | | | | | | | | | | | | | | | | | | | | | 23 | 22 | 19 | 4 |
| 3458 | 764 | B1.0|REF99_V4|12177 | 907 | B1.0|REF99_V4|4661 | | | | | | | | | | | | | | | | | | | | | 23 | 22 | 17 | 4 |
| 3459 | 764 | B1.0|REF99_V4|12177 | 826 | B1.0|REF99_V4|467 | | | | | | | | | | | | | | | | | | | | | 23 | 52 | 23 | 10 |
| 3460 | 764 | B1.0|REF99_V4|12177 | 854 | B1.0|REF99_V4|68277 | | | | | | | | | | | | | | | | | | | | | 23 | 23 | 19 | 4 |
| 3461 | 764 | B1.0|REF99_V4|12177 | 809 | B1.0|REF99_V4|74216 | | | | | | | | | | | | | | | | | | | | | 23 | 18 | 17 | 3 |
| 3462 | 764 | B1.0|REF99_V4|12177 | 793 | B1.0|REF99_V4|88875 | | | | | | | | | | | | | | | | | | | | | 23 | 19 | 16 | 3 |
| 3463 | 764 | B1.0|REF99_V4|12177 | 957 | B1.0|REF99_V4|921 | | | | | | | | | | | | | | | | | | | | | 23 | 46 | 22 | 9 |
| 3464 | 111 | B1.0|REF99_V4|1256 | 643 | B1.0|REF99_V4|176246 | | | | | | | | | | | | | | | | | | | | | 44 | 21 | 20 | 8 |
| 3465 | 111 | B1.0|REF99_V4|1256 | 816 | B1.0|REF99_V4|21134 | | | | | | | | | | | | | | | | | | | | | 44 | 26 | 22 | 9 |
| 3466 | 111 | B1.0|REF99_V4|1256 | 1175 | B1.0|REF99_V4|284 | | | | | | | | | | | | | | | | | | | | | 44 | 51 | 31 | 18 |
| 3467 | 111 | B1.0|REF99_V4|1256 | 852 | B1.0|REF99_V4|298 | | | | | | | | | | | | | | | | | | | | | 44 | 30 | 23 | 11 |
| 3468 | 111 | B1.0|REF99_V4|1256 | 701 | B1.0|REF99_V4|3785 | | | | | | | | | | | | | | | | | | | | | 44 | 22 | 21 | 8 |
| 3469 | 111 | B1.0|REF99_V4|1256 | 854 | B1.0|REF99_V4|68277 | | | | | | | | | | | | | | | | | | | | | 44 | 23 | 21 | 8 |
| 3470 | 111 | B1.0|REF99_V4|1256 | 644 | B1.0|REF99_V4|7232 | | | | | | | | | | | | | | | | | | | | | 44 | 28 | 23 | 10 |
| 3471 | 953 | B1.0|REF99_V4|12728 | 234 | B1.0|REF99_V4|12784 | | | | | | | | | | | | | | | | | | | | | 25 | 25 | 19 | 5 |
| 3472 | 953 | B1.0|REF99_V4|12728 | 800 | B1.0|REF99_V4|156812 | | | | | | | | | | | | | | | | | | | | | 25 | 37 | 21 | 8 |
| 3473 | 953 | B1.0|REF99_V4|12728 | 717 | B1.0|REF99_V4|17223 | | | | | | | | | | | | | | | | | | | | | 25 | 35 | 21 | 7 |
| 3474 | 953 | B1.0|REF99_V4|12728 | 721 | B1.0|REF99_V4|174886 | | | | | | | | | | | | | | | | | | | | | 25 | 21 | 17 | 4 |
| 3475 | 953 | B1.0|REF99_V4|12728 | 643 | B1.0|REF99_V4|176246 | | | | | | | | | | | | | | | | | | | | | 25 | 21 | 19 | 4 |
| 3476 | 953 | B1.0|REF99_V4|12728 | 804 | B1.0|REF99_V4|1838 | | | | | | | | | | | | | | | | | | | | | 25 | 29 | 19 | 6 |
| 3477 | 953 | B1.0|REF99_V4|12728 | 763 | B1.0|REF99_V4|197072 | | | | | | | | | | | | | | | | | | | | | 25 | 21 | 18 | 4 |
| 3478 | 953 | B1.0|REF99_V4|12728 | 816 | B1.0|REF99_V4|21134 | | | | | | | | | | | | | | | | | | | | | 25 | 26 | 18 | 5 |
| 3479 | 953 | B1.0|REF99_V4|12728 | 824 | B1.0|REF99_V4|211723 | | | | | | | | | | | | | | | | | | | | | 25 | 22 | 18 | 5 |
| 3480 | 953 | B1.0|REF99_V4|12728 | 703 | B1.0|REF99_V4|2242 | | | | | | | | | | | | | | | | | | | | | 25 | 17 | 16 | 4 |
| 3481 | 953 | B1.0|REF99_V4|12728 | 852 | B1.0|REF99_V4|298 | | | | | | | | | | | | | | | | | | | | | 25 | 30 | 20 | 6 |
| 3482 | 953 | B1.0|REF99_V4|12728 | 701 | B1.0|REF99_V4|3785 | | | | | | | | | | | | | | | | | | | | | 25 | 22 | 17 | 5 |
| 3483 | 953 | B1.0|REF99_V4|12728 | 719 | B1.0|REF99_V4|385 | | | | | | | | | | | | | | | | | | | | | 25 | 45 | 22 | 9 |

| PAIR | B Endophyte 1 (SEQ ID NO:) | C Endophyte 1 (OTU) | D Endophyte 2 (SEQ ID NO:) | E Endophyte 2 (OTU) | F Bacteria - cultivated N1 | N2 | OC | EC | G Bacteria - cultivated, roots N1 | N2 | OC | EC | H Bacteria - cultivated, seeds N1 | N2 | OC | EC | I Bacteria - wild N1 | N2 | OC | EC | J Bacteria - wild, roots N1 | N2 | OC | EC | K Bacteria - wild, seeds N1 | N2 | OC | EC |
|---|---|---|---|---|---|---|---|---|---|---|---|---|---|---|---|---|---|---|---|---|---|---|---|---|---|---|---|---|
| 3484 | 953 | B1.0\|REF99_V4\|12728 | 907 | B1.0\|REF99_V4\|4661 | | | | | | | | | | | | | | | | | | | | | 25 | 22 | 20 | 5 |
| 3485 | 953 | B1.0\|REF99_V4\|12728 | 826 | B1.0\|REF99_V4\|467 | | | | | | | | | | | | | | | | | | | | | 25 | 52 | 23 | 11 |
| 3486 | 953 | B1.0\|REF99_V4\|12728 | 1199 | B1.0\|REF99_V4\|589 | | | | | | | | | | | | | | | | | | | | | 25 | 39 | 21 | 8 |
| 3487 | 953 | B1.0\|REF99_V4\|12728 | 117 | B1.0\|REF99_V4\|6561 | | | | | | | | | | | | | | | | | | | | | 25 | 19 | 17 | 4 |
| 3488 | 953 | B1.0\|REF99_V4\|12728 | 854 | B1.0\|REF99_V4\|68277 | | | | | | | | | | | | | | | | | | | | | 25 | 23 | 19 | 5 |
| 3489 | 953 | B1.0\|REF99_V4\|12728 | 841 | B1.0\|REF99_V4\|719 | | | | | | | | | | | | | | | | | | | | | 25 | 33 | 19 | 7 |
| 3490 | 953 | B1.0\|REF99_V4\|12728 | 957 | B1.0\|REF99_V4\|921 | | | | | | | | | | | | | | | | | | | | | 25 | 46 | 22 | 9 |
| 3491 | 234 | B1.0\|REF99_V4\|12784 | 84 | B1.0\|REF99_V4\|13862 | | | | | | | | | | | | | | | | | | | | | 25 | 25 | 18 | 5 |
| 3492 | 234 | B1.0\|REF99_V4\|12784 | 800 | B1.0\|REF99_V4\|156812 | | | | | | | | | | | | | | | | | | | | | 25 | 37 | 20 | 8 |
| 3493 | 234 | B1.0\|REF99_V4\|12784 | 643 | B1.0\|REF99_V4\|176246 | | | | | | | | | | | | | | | | | | | | | 25 | 21 | 18 | 4 |
| 3494 | 234 | B1.0\|REF99_V4\|12784 | 265 | B1.0\|REF99_V4\|190866 | | | | | | | | | | | | | | | | | | | | | 25 | 22 | 18 | 5 |
| 3495 | 234 | B1.0\|REF99_V4\|12784 | 763 | B1.0\|REF99_V4\|197072 | | | | | | | | | | | | | | | | | | | | | 25 | 21 | 17 | 4 |
| 3496 | 234 | B1.0\|REF99_V4\|12784 | 824 | B1.0\|REF99_V4\|211723 | | | | | | | | | | | | | | | | | | | | | 25 | 22 | 17 | 5 |
| 3497 | 234 | B1.0\|REF99_V4\|12784 | 852 | B1.0\|REF99_V4\|298 | | | | | | | | | | | | | | | | | | | | | 25 | 30 | 20 | 6 |
| 3498 | 234 | B1.0\|REF99_V4\|12784 | 701 | B1.0\|REF99_V4\|3785 | | | | | | | | | | | | | | | | | | | | | 25 | 22 | 18 | 5 |
| 3499 | 234 | B1.0\|REF99_V4\|12784 | 907 | B1.0\|REF99_V4\|4661 | | | | | | | | | | | | | | | | | | | | | 25 | 22 | 17 | 5 |
| 3500 | 234 | B1.0\|REF99_V4\|12784 | 841 | B1.0\|REF99_V4\|719 | | | | | | | | | | | | | | | | | | | | | 25 | 33 | 20 | 7 |
| 3501 | 234 | B1.0\|REF99_V4\|12784 | 644 | B1.0\|REF99_V4\|7232 | | | | | | | | | | | | | | | | | | | | | 25 | 28 | 18 | 6 |
| 3502 | 1159 | B1.0\|REF99_V4\|138 | 1188 | B1.0\|REF99_V4\|150 | | | | | | | | | | | | | | | | | | | | | 29 | 45 | 24 | 11 |
| 3503 | 1159 | B1.0\|REF99_V4\|138 | 800 | B1.0\|REF99_V4\|156812 | | | | | | | | | | | | | | | | | | | | | 29 | 37 | 22 | 9 |
| 3504 | 1159 | B1.0\|REF99_V4\|138 | 1199 | B1.0\|REF99_V4\|589 | | | | | | | | | | | | | | | | | | | | | 29 | 39 | 23 | 9 |
| 3505 | 84 | B1.0\|REF99_V4\|13862 | 643 | B1.0\|REF99_V4\|176246 | | | | | | | | | | | | | | | | | | | | | 25 | 21 | 17 | 4 |
| 3506 | 84 | B1.0\|REF99_V4\|13862 | 804 | B1.0\|REF99_V4\|1838 | | | | | | | | | | | | | | | | | | | | | 25 | 29 | 19 | 6 |
| 3507 | 84 | B1.0\|REF99_V4\|13862 | 824 | B1.0\|REF99_V4\|211723 | | | | | | | | | | | | | | | | | | | | | 25 | 22 | 17 | 5 |
| 3508 | 84 | B1.0\|REF99_V4\|13862 | 105 | B1.0\|REF99_V4\|2738 | | | | | | | | | | | | | | | | | | | | | 25 | 26 | 18 | 6 |
| 3509 | 84 | B1.0\|REF99_V4\|13862 | 701 | B1.0\|REF99_V4\|3785 | | | | | | | | | | | | | | | | | | | | | 25 | 22 | 17 | 5 |
| 3510 | 84 | B1.0\|REF99_V4\|13862 | 854 | B1.0\|REF99_V4\|68277 | | | | | | | | | | | | | | | | | | | | | 25 | 23 | 17 | 5 |
| 3511 | 84 | B1.0\|REF99_V4\|13862 | 841 | B1.0\|REF99_V4\|719 | | | | | | | | | | | | | | | | | | | | | 25 | 33 | 20 | 7 |
| 3512 | 84 | B1.0\|REF99_V4\|13862 | 644 | B1.0\|REF99_V4\|7232 | | | | | | | | | | | | | | | | | | | | | 25 | 28 | 18 | 6 |
| 3513 | 800 | B1.0\|REF99_V4\|156812 | 684 | B1.0\|REF99_V4\|172 | | | | | | | | | | | | | | | | | | | | | 25 | 60 | 31 | 18 |
| 3514 | 800 | B1.0\|REF99_V4\|156812 | 643 | B1.0\|REF99_V4\|176246 | | | | | | | | | | | | | | | | | | | | | 37 | 21 | 20 | 6 |
| 3515 | 800 | B1.0\|REF99_V4\|156812 | 265 | B1.0\|REF99_V4\|190866 | | | | | | | | | | | | | | | | | | | | | 37 | 22 | 20 | 7 |
| 3516 | 800 | B1.0\|REF99_V4\|156812 | 763 | B1.0\|REF99_V4\|197072 | | | | | | | | | | | | | | | | | | | | | 37 | 21 | 19 | 6 |
| 3517 | 800 | B1.0\|REF99_V4\|156812 | 816 | B1.0\|REF99_V4\|211134 | | | | | | | | | | | | | | | | | | | | | 37 | 26 | 21 | 8 |
| 3518 | 800 | B1.0\|REF99_V4\|156812 | 640 | B1.0\|REF99_V4\|211419 | | | | | | | | | | | | | | | | | | | | | 37 | 20 | 19 | 6 |
| 3519 | 800 | B1.0\|REF99_V4\|156812 | 824 | B1.0\|REF99_V4\|211723 | | | | | | | | | | | | | | | | | | | | | 37 | 22 | 20 | 7 |
| 3520 | 800 | B1.0\|REF99_V4\|156812 | 110 | B1.0\|REF99_V4\|24254 | | | | | | | | | | | | | | | | | | | | | 37 | 19 | 18 | 6 |
| 3521 | 800 | B1.0\|REF99_V4\|156812 | 105 | B1.0\|REF99_V4\|2738 | | | | | | | | | | | | | | | | | | | | | 37 | 26 | 21 | 8 |
| 3522 | 800 | B1.0\|REF99_V4\|156812 | 701 | B1.0\|REF99_V4\|3785 | | | | | | | | | | | | | | | | | | | | | 37 | 22 | 20 | 7 |
| 3523 | 800 | B1.0\|REF99_V4\|156812 | 907 | B1.0\|REF99_V4\|4661 | | | | | | | | | | | | | | | | | | | | | 37 | 22 | 21 | 7 |
| 3524 | 800 | B1.0\|REF99_V4\|156812 | 1241 | B1.0\|REF99_V4\|4511 | | | | | | | | | | | | | | | | | | | | | 37 | 24 | 20 | 7 |
| 3525 | 800 | B1.0\|REF99_V4\|156812 | 117 | B1.0\|REF99_V4\|6561 | | | | | | | | | | | | | | | | | | | | | 37 | 19 | 18 | 6 |
| 3526 | 800 | B1.0\|REF99_V4\|156812 | 854 | B1.0\|REF99_V4\|68277 | | | | | | | | | | | | | | | | | | | | | 37 | 23 | 20 | 7 |
| 3527 | 800 | B1.0\|REF99_V4\|156812 | 644 | B1.0\|REF99_V4\|7232 | | | | | | | | | | | | | | | | | | | | | 37 | 28 | 22 | 8 |
| 3528 | 800 | B1.0\|REF99_V4\|156812 | 929 | B1.0\|REF99_V4\|876 | | | | | | | | | | | | | | | | | | | | | 37 | 26 | 21 | 7 |
| 3529 | 800 | B1.0\|REF99_V4\|156812 | 1134 | B1.0\|REF99_V4\|986 | | | | | | | | | | | | | | | | | | | | | 37 | 41 | 25 | 12 |

TABLE 12-continued

| A PAIR | B Endophyte 1 (SEQ ID NO:) | C Endophyte 1 (OTU) | D Endophyte 2 (SEQ ID NO:) | E Endophyte 2 (OTU) | F Bacteria - cultivated | | | | G Bacteria - cultivated, roots | | | | H Bacteria - cultivated, seeds | | | | I Bacteria - wild | | | | J Bacteria - wild, roots | | | | K Bacteria - wild, seeds | | | |
|---|---|---|---|---|---|---|---|---|---|---|---|---|---|---|---|---|---|---|---|---|---|---|---|---|---|---|---|---|
| | | | | | N1 | N2 | OC | EC | N1 | N2 | OC | EC | N1 | N2 | OC | EC | N1 | N2 | OC | EC | N1 | N2 | OC | EC | N1 | N2 | OC | EC |
| 3530 | 1097 | B1.0|REF99_V4|159716 | 1092 | B1.0|REF99_V4|76 | | | | | | | | | | | | | | | | | | | | | 30 | 38 | 22 | 9 |
| 3531 | 697 | B1.0|REF99_V4|162569 | 852 | B1.0|REF99_V4|298 | | | | | | | | | | | | | | | | | | | | | 18 | 30 | 17 | 4 |
| 3532 | 697 | B1.0|REF99_V4|162569 | 701 | B1.0|REF99_V4|3785 | | | | | | | | | | | | | | | | | | | | | 18 | 22 | 16 | 3 |
| 3533 | 684 | B1.0|REF99_V4|172 | 1175 | B1.0|REF99_V4|284 | | | | | | | | | | | | | | | | | | | | | 60 | 51 | 40 | 25 |
| 3534 | 684 | B1.0|REF99_V4|172 | 852 | B1.0|REF99_V4|298 | | | | | | | | | | | | | | | | | | | | | 60 | 30 | 27 | 15 |
| 3535 | 684 | B1.0|REF99_V4|172 | 826 | B1.0|REF99_V4|467 | | | | | | | | | | | | | | | | | | | | | 60 | 52 | 39 | 25 |
| 3536 | 717 | B1.0|REF99_V4|17223 | 265 | B1.0|REF99_V4|190866 | | | | | | | | | | | | | | | | | | | | | 35 | 22 | 19 | 6 |
| 3537 | 717 | B1.0|REF99_V4|17223 | 816 | B1.0|REF99_V4|211134 | | | | | | | | | | | | | | | | | | | | | 35 | 26 | 20 | 7 |
| 3538 | 717 | B1.0|REF99_V4|17223 | 640 | B1.0|REF99_V4|211419 | | | | | | | | | | | | | | | | | | | | | 35 | 20 | 19 | 6 |
| 3539 | 717 | B1.0|REF99_V4|17223 | 681 | B1.0|REF99_V4|234 | | | | | | | | | | | | | | | | | | | | | 35 | 27 | 21 | 8 |
| 3540 | 717 | B1.0|REF99_V4|17223 | 105 | B1.0|REF99_V4|2738 | | | | | | | | | | | | | | | | | | | | | 35 | 26 | 20 | 7 |
| 3541 | 717 | B1.0|REF99_V4|17223 | 719 | B1.0|REF99_V4|385 | | | | | | | | | | | | | | | | | | | | | 35 | 45 | 26 | 13 |
| 3542 | 717 | B1.0|REF99_V4|17223 | 907 | B1.0|REF99_V4|4661 | | | | | | | | | | | | | | | | | | | | | 35 | 22 | 19 | 6 |
| 3543 | 717 | B1.0|REF99_V4|17223 | 1241 | B1.0|REF99_V4|511 | | | | | | | | | | | | | | | | | | | | | 35 | 24 | 20 | 7 |
| 3544 | 717 | B1.0|REF99_V4|17223 | 117 | B1.0|REF99_V4|6561 | | | | | | | | | | | | | | | | | | | | | 35 | 19 | 18 | 5 |
| 3545 | 717 | B1.0|REF99_V4|17223 | 854 | B1.0|REF99_V4|68277 | | | | | | | | | | | | | | | | | | | | | 35 | 23 | 20 | 7 |
| 3546 | 717 | B1.0|REF99_V4|17223 | 644 | B1.0|REF99_V4|7232 | | | | | | | | | | | | | | | | | | | | | 35 | 28 | 22 | 8 |
| 3547 | 721 | B1.0|REF99_V4|174886 | 643 | B1.0|REF99_V4|176246 | | | | | | | | | | | | | | | | | | | | | 21 | 21 | 17 | 4 |
| 3548 | 721 | B1.0|REF99_V4|174886 | 804 | B1.0|REF99_V4|1838 | | | | | | | | | | | | | | | | | | | | | 21 | 29 | 18 | 5 |
| 3549 | 721 | B1.0|REF99_V4|174886 | 640 | B1.0|REF99_V4|211419 | | | | | | | | | | | | | | | | | | | | | 21 | 20 | 16 | 3 |
| 3550 | 721 | B1.0|REF99_V4|174886 | 824 | B1.0|REF99_V4|211723 | | | | | | | | | | | | | | | | | | | | | 21 | 22 | 18 | 4 |
| 3551 | 721 | B1.0|REF99_V4|174886 | 703 | B1.0|REF99_V4|2242 | | | | | | | | | | | | | | | | | | | | | 21 | 17 | 16 | 3 |
| 3552 | 721 | B1.0|REF99_V4|174886 | 1175 | B1.0|REF99_V4|284 | | | | | | | | | | | | | | | | | | | | | 21 | 51 | 21 | 9 |
| 3553 | 721 | B1.0|REF99_V4|174886 | 852 | B1.0|REF99_V4|298 | | | | | | | | | | | | | | | | | | | | | 21 | 30 | 18 | 5 |
| 3554 | 721 | B1.0|REF99_V4|174886 | 701 | B1.0|REF99_V4|3785 | | | | | | | | | | | | | | | | | | | | | 21 | 22 | 17 | 4 |
| 3555 | 721 | B1.0|REF99_V4|174886 | 719 | B1.0|REF99_V4|385 | | | | | | | | | | | | | | | | | | | | | 21 | 45 | 20 | 8 |
| 3556 | 721 | B1.0|REF99_V4|174886 | 1241 | B1.0|REF99_V4|511 | | | | | | | | | | | | | | | | | | | | | 21 | 24 | 17 | 4 |
| 3557 | 721 | B1.0|REF99_V4|174886 | 1199 | B1.0|REF99_V4|589 | | | | | | | | | | | | | | | | | | | | | 21 | 39 | 19 | 7 |
| 3558 | 721 | B1.0|REF99_V4|174886 | 804 | B1.0|REF99_V4|1838 | | | | | | | | | | | | | | | | | | | | | 21 | 29 | 19 | 5 |
| 3559 | 643 | B1.0|REF99_V4|176246 | 265 | B1.0|REF99_V4|190866 | | | | | | | | | | | | | | | | | | | | | 21 | 22 | 18 | 4 |
| 3560 | 643 | B1.0|REF99_V4|176246 | 763 | B1.0|REF99_V4|197072 | | | | | | | | | | | | | | | | | | | | | 21 | 21 | 17 | 4 |
| 3561 | 643 | B1.0|REF99_V4|176246 | 816 | B1.0|REF99_V4|211134 | | | | | | | | | | | | | | | | | | | | | 21 | 26 | 19 | 4 |
| 3562 | 643 | B1.0|REF99_V4|176246 | 824 | B1.0|REF99_V4|211723 | | | | | | | | | | | | | | | | | | | | | 21 | 22 | 19 | 4 |
| 3563 | 643 | B1.0|REF99_V4|176246 | 105 | B1.0|REF99_V4|2738 | | | | | | | | | | | | | | | | | | | | | 21 | 26 | 17 | 4 |
| 3564 | 643 | B1.0|REF99_V4|176246 | 1175 | B1.0|REF99_V4|284 | | | | | | | | | | | | | | | | | | | | | 21 | 51 | 21 | 9 |
| 3565 | 643 | B1.0|REF99_V4|176246 | 852 | B1.0|REF99_V4|298 | | | | | | | | | | | | | | | | | | | | | 21 | 30 | 20 | 5 |
| 3566 | 643 | B1.0|REF99_V4|176246 | 701 | B1.0|REF99_V4|3785 | | | | | | | | | | | | | | | | | | | | | 21 | 22 | 18 | 4 |
| 3567 | 643 | B1.0|REF99_V4|176246 | 907 | B1.0|REF99_V4|4661 | | | | | | | | | | | | | | | | | | | | | 21 | 24 | 19 | 4 |
| 3568 | 643 | B1.0|REF99_V4|176246 | 1241 | B1.0|REF99_V4|511 | | | | | | | | | | | | | | | | | | | | | 21 | 24 | 18 | 4 |
| 3569 | 643 | B1.0|REF99_V4|176246 | 825 | B1.0|REF99_V4|5606 | | | | | | | | | | | | | | | | | | | | | 21 | 21 | 16 | 4 |
| 3570 | 643 | B1.0|REF99_V4|176246 | 1199 | B1.0|REF99_V4|589 | | | | | | | | | | | | | | | | | | | | | 21 | 39 | 19 | 7 |
| 3571 | 643 | B1.0|REF99_V4|176246 | 117 | B1.0|REF99_V4|6561 | | | | | | | | | | | | | | | | | | | | | 21 | 19 | 16 | 3 |
| 3572 | 643 | B1.0|REF99_V4|176246 | 854 | B1.0|REF99_V4|68277 | | | | | | | | | | | | | | | | | | | | | 21 | 23 | 18 | 4 |
| 3573 | 643 | B1.0|REF99_V4|176246 | 644 | B1.0|REF99_V4|7232 | | | | | | | | | | | | | | | | | | | | | 21 | 28 | 18 | 5 |
| 3574 | 643 | B1.0|REF99_V4|176246 | 809 | B1.0|REF99_V4|74216 | | | | | | | | | | | | | | | | | | | | | 21 | 18 | 16 | 3 |
| 3575 | 804 | B1.0|REF99_V4|1838 | 265 | B1.0|REF99_V4|190866 | | | | | | | | | | | | | | | | | | | | | 29 | 22 | 19 | 5 |

TABLE 12-continued

| A | B | C | D | E | F Bacteria - cultivated | | | | G Bacteria - cultivated, roots | | | | H Bacteria - cultivated, seeds | | | | I Bacteria - wild | | | | J Bacteria - wild, roots | | | | K Bacteria - wild, seeds | | | |
|---|---|---|---|---|---|---|---|---|---|---|---|---|---|---|---|---|---|---|---|---|---|---|---|---|---|---|---|---|---|---|
| | | | | | | | | | | | | | | | | | | | | | | | | | | | | | | |
| PAIR | Endophyte 1 (SEQ ID NO:) | Endophyte 1 (OTU) | Endophyte 2 (SEQ ID NO:) | Endophyte 2 (OTU) | N1 | N2 | OC | EC | N1 | N2 | OC | EC | N1 | N2 | OC | EC | N1 | N2 | OC | EC | N1 | N2 | OC | EC | N1 | N2 | OC | EC |
| 3576 | 804 | B1.0|REF99_V4|1838 | 640 | B1.0|REF99_V4|211419 | | | | | | | | | | | | | | | | | | | | | | 29 | 20 | 17 | 5 |
| 3577 | 804 | B1.0|REF99_V4|1838 | 105 | B1.0|REF99_V4|2738 | | | | | | | | | | | | | | | | | | | | | | 29 | 26 | 19 | 6 |
| 3578 | 804 | B1.0|REF99_V4|1838 | 701 | B1.0|REF99_V4|3785 | | | | | | | | | | | | | | | | | | | | | | 29 | 22 | 18 | 5 |
| 3579 | 804 | B1.0|REF99_V4|1838 | 719 | B1.0|REF99_V4|385 | | | | | | | | | | | | | | | | | | | | | | 29 | 45 | 24 | 11 |
| 3580 | 804 | B1.0|REF99_V4|1838 | 826 | B1.0|REF99_V4|467 | | | | | | | | | | | | | | | | | | | | | | 29 | 52 | 25 | 12 |
| 3581 | 804 | B1.0|REF99_V4|1838 | 1241 | B1.0|REF99_V4|511 | | | | | | | | | | | | | | | | | | | | | | 29 | 24 | 18 | 6 |
| 3582 | 804 | B1.0|REF99_V4|1838 | 1199 | B1.0|REF99_V4|589 | | | | | | | | | | | | | | | | | | | | | | 29 | 39 | 23 | 9 |
| 3583 | 804 | B1.0|REF99_V4|1838 | 854 | B1.0|REF99_V4|68277 | | | | | | | | | | | | | | | | | | | | | | 29 | 23 | 18 | 5 |
| 3584 | 804 | B1.0|REF99_V4|1838 | 841 | B1.0|REF99_V4|719 | | | | | | | | | | | | | | | | | | | | | | 29 | 33 | 21 | 8 |
| 3585 | 804 | B1.0|REF99_V4|1838 | 644 | B1.0|REF99_V4|7232 | | | | | | | | | | | | | | | | | | | | | | 29 | 28 | 20 | 7 |
| 3586 | 804 | B1.0|REF99_V4|1838 | 809 | B1.0|REF99_V4|74216 | | | | | | | | | | | | | | | | | | | | | | 29 | 18 | 17 | 4 |
| 3587 | 265 | B1.0|REF99_V4|190866 | 763 | B1.0|REF99_V4|197072 | | | | | | | | | | | | | | | | | | | | | | 22 | 21 | 18 | 4 |
| 3588 | 265 | B1.0|REF99_V4|190866 | 816 | B1.0|REF99_V4|21134 | | | | | | | | | | | | | | | | | | | | | | 22 | 26 | 19 | 5 |
| 3589 | 265 | B1.0|REF99_V4|190866 | 824 | B1.0|REF99_V4|211723 | | | | | | | | | | | | | | | | | | | | | | 22 | 22 | 18 | 4 |
| 3590 | 265 | B1.0|REF99_V4|190866 | 105 | B1.0|REF99_V4|2738 | | | | | | | | | | | | | | | | | | | | | | 22 | 26 | 19 | 5 |
| 3591 | 265 | B1.0|REF99_V4|190866 | 852 | B1.0|REF99_V4|298 | | | | | | | | | | | | | | | | | | | | | | 22 | 30 | 20 | 5 |
| 3592 | 265 | B1.0|REF99_V4|190866 | 701 | B1.0|REF99_V4|3785 | | | | | | | | | | | | | | | | | | | | | | 22 | 22 | 17 | 4 |
| 3593 | 265 | B1.0|REF99_V4|190866 | 907 | B1.0|REF99_V4|4661 | | | | | | | | | | | | | | | | | | | | | | 22 | 22 | 18 | 4 |
| 3594 | 265 | B1.0|REF99_V4|190866 | 854 | B1.0|REF99_V4|68277 | | | | | | | | | | | | | | | | | | | | | | 22 | 23 | 17 | 4 |
| 3595 | 265 | B1.0|REF99_V4|190866 | 841 | B1.0|REF99_V4|719 | | | | | | | | | | | | | | | | | | | | | | 22 | 33 | 19 | 6 |
| 3596 | 265 | B1.0|REF99_V4|190866 | 644 | B1.0|REF99_V4|7232 | | | | | | | | | | | | | | | | | | | | | | 22 | 28 | 18 | 5 |
| 3597 | 265 | B1.0|REF99_V4|190866 | 957 | B1.0|REF99_V4|921 | | | | | | | | | | | | | | | | | | | | | | 22 | 46 | 21 | 8 |
| 3598 | 1195 | B1.0|REF99_V4|1916 | 1005 | B1.0|REF99_V4|598 | | | | | | | | | | | | | | | | | | | | | | 33 | 32 | 21 | 9 |
| 3599 | 763 | B1.0|REF99_V4|197072 | 816 | B1.0|REF99_V4|21134 | | | | | | | | | | | | | | | | | | | | | | 21 | 26 | 18 | 4 |
| 3600 | 763 | B1.0|REF99_V4|197072 | 907 | B1.0|REF99_V4|4661 | | | | | | | | | | | | | | | | | | | | | | 21 | 22 | 17 | 4 |
| 3601 | 763 | B1.0|REF99_V4|197072 | 825 | B1.0|REF99_V4|5606 | | | | | | | | | | | | | | | | | | | | | | 21 | 21 | 17 | 4 |
| 3602 | 763 | B1.0|REF99_V4|197072 | 854 | B1.0|REF99_V4|68277 | | | | | | | | | | | | | | | | | | | | | | 21 | 23 | 17 | 4 |
| 3603 | 522 | B1.0|REF99_V4|1799 | 1090 | B1.0|REF99_V4|79117 | | | | | | | | | | | | | | | | | | | | | | 22 | 37 | 19 | 7 |
| 3604 | 816 | B1.0|REF99_V4|21134 | 824 | B1.0|REF99_V4|211723 | | | | | | | | | | | | | | | | | | | | | | 26 | 22 | 18 | 5 |
| 3605 | 816 | B1.0|REF99_V4|21134 | 105 | B1.0|REF99_V4|2738 | | | | | | | | | | | | | | | | | | | | | | 26 | 26 | 18 | 6 |
| 3606 | 816 | B1.0|REF99_V4|21134 | 719 | B1.0|REF99_V4|385 | | | | | | | | | | | | | | | | | | | | | | 26 | 45 | 23 | 10 |
| 3607 | 816 | B1.0|REF99_V4|21134 | 1241 | B1.0|REF99_V4|511 | | | | | | | | | | | | | | | | | | | | | | 26 | 24 | 18 | 5 |
| 3608 | 816 | B1.0|REF99_V4|21134 | 825 | B1.0|REF99_V4|5606 | | | | | | | | | | | | | | | | | | | | | | 26 | 21 | 17 | 4 |
| 3609 | 816 | B1.0|REF99_V4|21134 | 809 | B1.0|REF99_V4|74216 | | | | | | | | | | | | | | | | | | | | | | 26 | 18 | 18 | 4 |
| 3610 | 816 | B1.0|REF99_V4|21134 | 957 | B1.0|REF99_V4|921 | | | | | | | | | | | | | | | | | | | | | | 26 | 46 | 22 | 10 |
| 3611 | 640 | B1.0|REF99_V4|211419 | 824 | B1.0|REF99_V4|211723 | | | | | | | | | | | | | | | | | | | | | | 20 | 22 | 17 | 4 |
| 3612 | 640 | B1.0|REF99_V4|211419 | 852 | B1.0|REF99_V4|298 | | | | | | | | | | | | | | | | | | | | | | 20 | 30 | 18 | 5 |
| 3613 | 640 | B1.0|REF99_V4|211419 | 701 | B1.0|REF99_V4|3785 | | | | | | | | | | | | | | | | | | | | | | 20 | 22 | 18 | 4 |
| 3614 | 640 | B1.0|REF99_V4|211419 | 854 | B1.0|REF99_V4|68277 | | | | | | | | | | | | | | | | | | | | | | 20 | 23 | 16 | 4 |
| 3615 | 640 | B1.0|REF99_V4|211419 | 644 | B1.0|REF99_V4|7232 | | | | | | | | | | | | | | | | | | | | | | 20 | 28 | 18 | 5 |
| 3616 | 640 | B1.0|REF99_V4|211419 | 929 | B1.0|REF99_V4|876 | | | | | | | | | | | | | | | | | | | | | | 20 | 26 | 17 | 4 |
| 3617 | 824 | B1.0|REF99_V4|211723 | 105 | B1.0|REF99_V4|2738 | | | | | | | | | | | | | | | | | | | | | | 22 | 26 | 17 | 5 |
| 3618 | 824 | B1.0|REF99_V4|211723 | 1175 | B1.0|REF99_V4|284 | | | | | | | | | | | | | | | | | | | | | | 22 | 51 | 22 | 9 |
| 3619 | 824 | B1.0|REF99_V4|211723 | 852 | B1.0|REF99_V4|298 | | | | | | | | | | | | | | | | | | | | | | 22 | 30 | 20 | 5 |
| 3620 | 824 | B1.0|REF99_V4|211723 | 701 | B1.0|REF99_V4|3785 | | | | | | | | | | | | | | | | | | | | | | 22 | 22 | 19 | 4 |
| 3621 | 824 | B1.0|REF99_V4|211723 | 907 | B1.0|REF99_V4|4661 | | | | | | | | | | | | | | | | | | | | | | 22 | 22 | 17 | 4 |

TABLE 12-continued

| A PAIR | B Endophyte 1 (SEQ ID NO:) | C Endophyte 1 (OTU) | D Endophyte 2 (SEQ ID NO:) | E Endophyte 2 (OTU) | F Bacteria - cultivated N1 | F N2 | F OC | F EC | G Bacteria - cultivated, roots N1 | G N2 | G OC | G EC | H Bacteria - cultivated, seeds N1 | H N2 | H OC | H EC | I Bacteria - wild N1 | I N2 | I OC | I EC | J Bacteria - wild, roots N1 | J N2 | J OC | J EC | K Bacteria - wild, seeds N1 | K N2 | K OC | K EC |
|---|---|---|---|---|---|---|---|---|---|---|---|---|---|---|---|---|---|---|---|---|---|---|---|---|---|---|---|---|
| 3622 | 824 | B1.0|REF99_V4|211723 | 826 | B1.0|REF99_V4|1467 | | | | | | | | | | | | | | | | | | | | | 22 | 52 | 22 | 9 |
| 3623 | 824 | B1.0|REF99_V4|211723 | 1241 | B1.0|REF99_V4|511 | | | | | | | | | | | | | | | | | | | | | 22 | 24 | 18 | 4 |
| 3624 | 824 | B1.0|REF99_V4|211723 | 1199 | B1.0|REF99_V4|589 | | | | | | | | | | | | | | | | | | | | | 22 | 39 | 20 | 7 |
| 3625 | 824 | B1.0|REF99_V4|211723 | 117 | B1.0|REF99_V4|6561 | | | | | | | | | | | | | | | | | | | | | 22 | 19 | 16 | 3 |
| 3626 | 824 | B1.0|REF99_V4|211723 | 854 | B1.0|REF99_V4|68277 | | | | | | | | | | | | | | | | | | | | | 22 | 23 | 17 | 4 |
| 3627 | 824 | B1.0|REF99_V4|211723 | 644 | B1.0|REF99_V4|7232 | | | | | | | | | | | | | | | | | | | | | 22 | 28 | 19 | 5 |
| 3628 | 824 | B1.0|REF99_V4|211723 | 809 | B1.0|REF99_V4|74216 | | | | | | | | | | | | | | | | | | | | | 22 | 18 | 16 | 3 |
| 3629 | 824 | B1.0|REF99_V4|211723 | 929 | B1.0|REF99_V4|876 | | | | | | | | | | | | | | | | | | | | | 22 | 26 | 18 | 5 |
| 3630 | 824 | B1.0|REF99_V4|211723 | 793 | B1.0|REF99_V4|88875 | | | | | | | | | | | | | | | | | | | | | 22 | 17 | 16 | 3 |
| 3631 | 824 | B1.0|REF99_V4|211723 | 957 | B1.0|REF99_V4|921 | | | | | | | | | | | | | | | | | | | | | 22 | 46 | 21 | 8 |
| 3632 | 703 | B1.0|REF99_V4|2242 | 681 | B1.0|REF99_V4|234 | | | | | | | | | | | | | | | | | | | | | 17 | 27 | 16 | 4 |
| 3633 | 703 | B1.0|REF99_V4|2242 | 105 | B1.0|REF99_V4|2738 | | | | | | | | | | | | | | | | | | | | | 17 | 26 | 16 | 4 |
| 3634 | 110 | B1.0|REF99_V4|24254 | 105 | B1.0|REF99_V4|2738 | | | | | | | | | | | | | | | | | | | | | 19 | 26 | 18 | 4 |
| 3635 | 110 | B1.0|REF99_V4|24254 | 852 | B1.0|REF99_V4|298 | | | | | | | | | | | | | | | | | | | | | 30 | 17 | 16 | 5 |
| 3636 | 110 | B1.0|REF99_V4|24254 | 95 | B1.0|REF99_V4|72556 | | | | | | | | | | | | | | | | | | | | | 19 | 17 | 16 | 3 |
| 3637 | 105 | B1.0|REF99_V4|2738 | 701 | B1.0|REF99_V4|3785 | | | | | | | | | | | | | | | | | | | | | 26 | 22 | 17 | 5 |
| 3638 | 105 | B1.0|REF99_V4|2738 | 1241 | B1.0|REF99_V4|511 | | | | | | | | | | | | | | | | | | | | | 26 | 24 | 18 | 5 |
| 3639 | 105 | B1.0|REF99_V4|2738 | 95 | B1.0|REF99_V4|72556 | | | | | | | | | | | | | | | | | | | | | 26 | 17 | 16 | 4 |
| 3640 | 1175 | B1.0|REF99_V4|284 | 852 | B1.0|REF99_V4|298 | | | | | | | | | | | | | | | | | | | | | 51 | 30 | 26 | 12 |
| 3641 | 1175 | B1.0|REF99_V4|284 | 701 | B1.0|REF99_V4|3785 | | | | | | | | | | | | | | | | | | | | | 51 | 22 | 22 | 9 |
| 3642 | 1093 | B1.0|REF99_V4|29 | 1092 | B1.0|REF99_V4|76 | | | | | | | | | | | | | | | | | | | | | 43 | 38 | 26 | 13 |
| 3643 | 852 | B1.0|REF99_V4|298 | 701 | B1.0|REF99_V4|3785 | | | | | | | | | | | | | | | | | | | | | 30 | 22 | 20 | 5 |
| 3644 | 852 | B1.0|REF99_V4|298 | 907 | B1.0|REF99_V4|44661 | | | | | | | | | | | | | | | | | | | | | 30 | 22 | 21 | 5 |
| 3645 | 852 | B1.0|REF99_V4|298 | 1241 | B1.0|REF99_V4|511 | | | | | | | | | | | | | | | | | | | | | 30 | 24 | 20 | 6 |
| 3646 | 852 | B1.0|REF99_V4|298 | 825 | B1.0|REF99_V4|5606 | | | | | | | | | | | | | | | | | | | | | 30 | 21 | 18 | 5 |
| 3647 | 852 | B1.0|REF99_V4|298 | 1199 | B1.0|REF99_V4|589 | | | | | | | | | | | | | | | | | | | | | 30 | 39 | 23 | 10 |
| 3648 | 852 | B1.0|REF99_V4|298 | 117 | B1.0|REF99_V4|6561 | | | | | | | | | | | | | | | | | | | | | 30 | 19 | 17 | 5 |
| 3649 | 852 | B1.0|REF99_V4|298 | 854 | B1.0|REF99_V4|68277 | | | | | | | | | | | | | | | | | | | | | 30 | 23 | 18 | 6 |
| 3650 | 852 | B1.0|REF99_V4|298 | 644 | B1.0|REF99_V4|7232 | | | | | | | | | | | | | | | | | | | | | 30 | 28 | 20 | 7 |
| 3651 | 852 | B1.0|REF99_V4|298 | 929 | B1.0|REF99_V4|876 | | | | | | | | | | | | | | | | | | | | | 30 | 26 | 19 | 6 |
| 3652 | 852 | B1.0|REF99_V4|298 | 793 | B1.0|REF99_V4|88875 | | | | | | | | | | | | | | | | | | | | | 30 | 17 | 17 | 4 |
| 3653 | 852 | B1.0|REF99_V4|298 | 957 | B1.0|REF99_V4|921 | | | | | | | | | | | | | | | | | | | | | 30 | 46 | 24 | 11 |
| 3654 | 852 | B1.0|REF99_V4|298 | 826 | B1.0|REF99_V4|1467 | | | | | | | | | | | | | | | | | | | | | 22 | 52 | 22 | 9 |
| 3655 | 701 | B1.0|REF99_V4|3785 | 1241 | B1.0|REF99_V4|511 | | | | | | | | | | | | | | | | | | | | | 22 | 24 | 17 | 4 |
| 3656 | 701 | B1.0|REF99_V4|3785 | 117 | B1.0|REF99_V4|6561 | | | | | | | | | | | | | | | | | | | | | 22 | 19 | 16 | 3 |
| 3657 | 701 | B1.0|REF99_V4|3785 | 929 | B1.0|REF99_V4|876 | | | | | | | | | | | | | | | | | | | | | 22 | 26 | 18 | 5 |
| 3658 | 701 | B1.0|REF99_V4|3785 | 793 | B1.0|REF99_V4|88875 | | | | | | | | | | | | | | | | | | | | | 22 | 17 | 16 | 3 |
| 3659 | 719 | B1.0|REF99_V4|385 | 423 | B1.0|REF99_V4|632 | | | | | | | | | | | | | | | | | | | | | 45 | 38 | 29 | 14 |
| 3660 | 719 | B1.0|REF99_V4|385 | 854 | B1.0|REF99_V4|68277 | | | | | | | | | | | | | | | | | | | | | 45 | 23 | 21 | 8 |
| 3661 | 907 | B1.0|REF99_V4|44661 | 1199 | B1.0|REF99_V4|589 | | | | | | | | | | | | | | | | | | | | | 22 | 39 | 20 | 7 |
| 3662 | 907 | B1.0|REF99_V4|44661 | 117 | B1.0|REF99_V4|6561 | | | | | | | | | | | | | | | | | | | | | 22 | 19 | 16 | 3 |
| 3663 | 907 | B1.0|REF99_V4|44661 | 957 | B1.0|REF99_V4|921 | | | | | | | | | | | | | | | | | | | | | 22 | 46 | 21 | 8 |
| 3664 | 826 | B1.0|REF99_V4|1467 | 1241 | B1.0|REF99_V4|511 | | | | | | | | | | | | | | | | | | | | | 52 | 24 | 23 | 10 |
| 3665 | 826 | B1.0|REF99_V4|1467 | 644 | B1.0|REF99_V4|7232 | | | | | | | | | | | | | | | | | | | | | 52 | 28 | 25 | 12 |
| 3666 | 1241 | B1.0|REF99_V4|511 | 854 | B1.0|REF99_V4|68277 | | | | | | | | | | | | | | | | | | | | | 24 | 23 | 18 | 5 |
| 3667 | 1241 | B1.0|REF99_V4|511 | 644 | B1.0|REF99_V4|7232 | | | | | | | | | | | | | | | | | | | | | 24 | 28 | 18 | 6 |

TABLE 12-continued

| A PAIR | B Endophyte 1 (SEQ ID NO:) | C Endophyte 1 (OTU) | D Endophyte 2 (SEQ ID NO:) | E Endophyte 2 (OTU) | F Bacteria - cultivated | | | | G Bacteria - cultivated, roots | | | | H Bacteria - cultivated, seeds | | | | I Bacteria - wild | | | | J Bacteria - wild, roots | | | | K Bacteria - wild, seeds | | | |
|---|---|---|---|---|---|---|---|---|---|---|---|---|---|---|---|---|---|---|---|---|---|---|---|---|---|---|---|---|
| | | | | | N1 | N2 | OC | EC | N1 | N2 | OC | EC | N1 | N2 | OC | EC | N1 | N2 | OC | EC | N1 | N2 | OC | EC | N1 | N2 | OC | EC |
| 3668 | 1241 | B1.0|REF99_V4|511 | 809 | B1.0|REF99_V4|74216 | | | | | | | | | | | | | | | | | | | | | 24 | 18 | 16 | 4 |
| 3669 | 1199 | B1.0|REF99_V4|589 | 510 | B1.0|REF99_V4|8981 | | | | | | | | | | | | | | | | | | | | | 39 | 41 | 26 | 13 |
| 3670 | 854 | B1.0|REF99_V4|68277 | 644 | B1.0|REF99_V4|7232 | | | | | | | | | | | | | | | | | | | | | 23 | 28 | 18 | 5 |
| 3671 | 854 | B1.0|REF99_V4|68277 | 809 | B1.0|REF99_V4|74216 | | | | | | | | | | | | | | | | | | | | | 23 | 18 | 16 | 3 |
| 3672 | 644 | B1.0|REF99_V4|7232 | 809 | B1.0|REF99_V4|74216 | | | | | | | | | | | | | | | | | | | | | 28 | 18 | 17 | 4 |
| 3673 | 644 | B1.0|REF99_V4|7232 | 957 | B1.0|REF99_V4|921 | | | | | | | | | | | | | | | | | | | | | 28 | 46 | 24 | 11 |

Table 13: Pairs of Endophytes Useful for the Present Invention, as Identified by Co-Occurrence Analysis of Various Plant Samples.

Column A shows the pair number. Columns B and C show the SEQ ID NO: and OTU designation for endophyte 1 of a pair. Columns D and E show the SEQ ID NO: and OTU designation for endophyte 2 of a pair. Columns F, G, H, I, J, and K show the number of times microbes belonging to OTU1 occur in a sample (N1), the number of times microbes belonging to OTU2 occur in a sample (N2), the number of times the microbes co-occur in all the plant samples of the collection or a subgroup of those plant samples (OC), and the number of times microbes of those OTUs would be expected to co-occur (EC). In this table, "Fungi—cultivated" represents a co-occurrence analysis using all cultivated plant samples of the collection, to identify fungi that co-occur in these samples. "Fungi—cultivated, roots" represents a co-occurrence analysis using only root samples from the cultivated plant samples of the collection, to identify fungi that co-occur in these samples. "Fungi—cultivated, seeds" represents a co-occurrence analysis using only seed samples from the cultivated plant samples of the collection, to identify fungi that co-occur in these samples. "Fungi—wild" represents a co-occurrence analysis using all wild plant samples of the collection, to identify fungi that co-occur in these samples. "Fungi—wild, roots" represents a co-occurrence analysis using only root samples from the wild plant samples of the collection, to identify fungi that co-occur in these samples. "Fungi—wild, seeds" represents a co-occurrence analysis using only seed samples from the wild plant samples of the collection, to identify fungi that co-occur in these samples.

TABLE 13

| A | B | C | D | E | F Fungi - cultivated | | | | G Fungi - cultivated, roots | | | | H Fungi - cultivated, seeds | | | | I Fungi - wild | | | | J Fungi - wild, roots | | | | K Fungi - wild, seeds | | | |
|---|---|---|---|---|---|---|---|---|---|---|---|---|---|---|---|---|---|---|---|---|---|---|---|---|---|---|---|---|---|
| PAIR | Endophyte 1 (SEQ ID NO:) | Endophyte 1 (OUT) | Endophyte 2 (SEQ ID NO:) | Endophyte 2 (OTU) | N1 | N2 | OC | EC | N1 | N2 | OC | EC | N1 | N2 | OC | EC | N1 | N2 | OC | EC | N1 | N2 | OC | EC | N1 | N2 | OC | EC |
| 3674 | 1673 | F1.0ISYM97_ITS1F122 | 1515 | F1.0ISYM97_ITS1F131 | 25 | 39 | 24 | 13 | | | | | | | | | | | | | | | | | | | | |
| 3675 | 1673 | F1.0ISYM97_ITS1F122 | 1683 | F1.0ISYM97_ITS1F151 | 25 | 27 | 19 | 9 | | | | | | | | | | | | | | | | | | | | |
| 3676 | 1673 | F1.0ISYM97_ITS1F122 | 1682 | F1.0ISYM97_ITS1F174 | 25 | 24 | 18 | 8 | | | | | | | | | | | | | | | | | | | | |
| 3677 | 1673 | F1.0ISYM97_ITS1F122 | 1575 | F1.0IUDYN_ITS1F37 | 25 | 36 | 22 | 12 | | | | | | | | | | | | | | | | | | | | |
| 3678 | 1515 | F1.0ISYM97_ITS1F131 | 1683 | F1.0ISYM97_ITS1F151 | 39 | 27 | 26 | 14 | | | | | | | | 30 | 19 | 18 | 5 | | | | | | | | |
| 3679 | 1515 | F1.0ISYM97_ITS1F131 | 1682 | F1.0ISYM97_ITS1F174 | 39 | 24 | 23 | 12 | | | | | | | | 30 | 24 | 21 | 7 | | | | | | | | |
| 3680 | 1515 | F1.0ISYM97_ITS1F131 | 1681 | F1.0IUDYN_ITS1F31 | 39 | 19 | 18 | 10 | | | | | | | | | | | | | | | | | | | | |
| 3681 | 1515 | F1.0ISYM97_ITS1F131 | 1574 | F1.0U97_ITS1F479 | 39 | 28 | 24 | 14 | | | | | | | | 30 | 23 | 21 | 6 | | | | | | | | |
| 3682 | 1515 | F1.0ISYM97_ITS1F131 | 1575 | F1.0ISYM97_ITS1F37 | 39 | 36 | 30 | 18 | | | | | | | | 30 | 24 | 22 | 7 | | | | | | | | |
| 3683 | 1515 | F1.0ISYM97_ITS1F131 | 1573 | F1.0ISYM97_ITS1F60 | 39 | 27 | 24 | 14 | | | | | | | | 30 | 18 | 17 | 5 | | | | | | | | |
| 3684 | 1515 | F1.0ISYM97_ITS1F131 | 1557 | F1.0IUDYN_ITS1F621 | 39 | 37 | 33 | 19 | | | | | | | | 30 | 24 | 19 | 7 | | | | | | | | |
| 3685 | 1683 | F1.0ISYM97_ITS1F151 | 1682 | F1.0ISYM97_ITS1F174 | 27 | 24 | 20 | 8 | | | | | 19 | 24 | 17 | 4 | 19 | 24 | 17 | 12 | | | | | |
| 3686 | 1683 | F1.0ISYM97_ITS1F151 | 1681 | F1.0IUDYN_ITS1F75 | 27 | 19 | 18 | 7 | | | | | | | | 19 | 15 | 12 | 8 | | | | |
| 3687 | 1683 | F1.0ISYM97_ITS1F151 | 1575 | F1.0ISYM97_ITS1F37 | 27 | 36 | 21 | 13 | | | | | | | | | | | | | | | | | | | | |
| 3688 | 1683 | F1.0ISYM97_ITS1F151 | 1575 | F1.0IUDYN_ITS1F37 | 27 | 37 | 24 | 13 | | | | | | | | | | | | | | | | | | | | |
| 3689 | 1682 | F1.0ISYM97_ITS1F174 | 1575 | F1.0IUDYN_ITS1F37 | 24 | 36 | 20 | 11 | | | | | | | | | | | | | | | | | | | | |
| 3690 | 1682 | F1.0ISYM97_ITS1F174 | 1557 | F1.0IUDYN_ITS1F621 | 24 | 37 | 21 | 12 | 27 | 24 | 20 | 15 | | | | | 24 | 24 | 17 | 5 | 24 | 20 | 15 | | | | | |
| 3691 | 1574 | F1.0U97_ITS1F479 | 1575 | F1.0ISYM97_ITS1F37 | 28 | 36 | 26 | 13 | 27 | 19 | 18 | 12 | | | | | 23 | 24 | 20 | 5 | 23 | 18 | 16 | 11 | | | | |
| 3692 | 1574 | F1.0U97_ITS1F479 | 1573 | F1.0ISYM97_ITS1F60 | 28 | 27 | 19 | 10 | | | | | | | | 23 | 18 | 16 | 4 | | | | | | | | |
| 3693 | 1574 | F1.0U97_ITS1F479 | 1557 | F1.0IUDYN_ITS1F621 | 28 | 37 | 27 | 14 | | | | | | | | | | | | | | | | | | | | |
| 3694 | 1655 | F1.0U97_ITS1F628 | 1533 | F1.0IUDYN_ITS1F458 | | | | | | | | | | | | | 37 | 29 | 28 | 10 | | | | | | | | |
| 3695 | 1575 | F1.0ISYM97_ITS1F37 | 1573 | F1.0IUDYN_ITS1F60 | 36 | 27 | 24 | 13 | | | | | | | | 24 | 18 | 18 | 4 | 24 | 18 | 18 | 12 | | | | |
| 3696 | 1575 | F1.0ISYM97_ITS1F37 | 1557 | F1.0IUDYN_ITS1F621 | 36 | 37 | 31 | 17 | 17 | 16 | 13 | 7 | | | | | | | | | | | | | | | | |
| 3697 | 1672 | F1.0IUDYN_ITS1F451 | 1655 | F1.0IUDYN_ITS1F628 | 46 | 44 | 39 | 26 | | | | | | | | 72 | 67 | 60 | 44 | 13 | 7 | 7 | 3 | | | | |
| 3698 | 1523 | F1.0IUDYN_ITS1F486 | 1481 | F1.0IUDYN_ITS1F548 | | | | | | | | | | | | | 42 | 57 | 36 | 22 | | | | | | | | |
| 3699 | 1523 | F1.0IUDYN_ITS1F486 | 1581 | F1.0IUDYN_ITS1F84 | 20 | 25 | 17 | 7 | | | | | 20 | 23 | 17 | 13 | 42 | 34 | 27 | 13 | | | | | | | | |
| 3700 | 1596 | F1.0IUDYN_ITS1F508 | 1592 | F1.0IUDYN_ITS1F627 | | | | | | | | | | | | | 25 | 18 | 18 | 4 | | | | | | | | |
| 3702 | 1573 | F1.0IUDYN_ITS1F60 | 1557 | F1.0IUDYN_ITS1F621 | 27 | 37 | 25 | 13 | | | | | | | | | | | | | | | | | | | | |
| 3707 | 1515 | F1.0ISYM97_ITS1F131 | 1690 | F1.0IUDYN_ITS1F463 | 39 | 22 | 20 | 11 | | | | | | | | | | | | | | | | | | | | |
| 3715 | 1682 | F1.0ISYM97_ITS1F174 | 1681 | F1.0ISYM97_ITS1F75 | 24 | 19 | 14 | 6 | | | | | | | | 57 | 67 | 47 | 35 | | | | | | | | |
| 3722 | 1481 | F1.0IUDYN_ITS1F548 | 1655 | F1.0IUDYN_ITS1F628 | 25 | 19 | 14 | 6 | | | | | | | | | | | | | | | | 36 | 29 | 28 | 15 |
| 3723 | 1673 | F1.0ISYM97_ITS1F122 | 1681 | F1.0IUDYN_ITS1F75 | 25 | 15 | 13 | 5 | | | | | | | | | | | | | | | | | | | | |
| 3724 | 1673 | F1.0ISYM97_ITS1F122 | 1595 | F1.0IUDYN_ITS1F38 | 25 | 32 | 19 | 10 | | | | | | | | | | | | 16 | 19 | 12 | 8 | | | | |
| 3725 | 1673 | F1.0ISYM97_ITS1F122 | 1605 | F1.0IUDYN_ITS1F6 | 25 | 22 | 18 | 9 | | | | | | | | | | | | | | | | | | | | |
| 3726 | 1673 | F1.0ISYM97_ITS1F122 | 1573 | F1.0IUDYN_ITS1F60 | 25 | 37 | 22 | 12 | | | | | | | | | | | | | | | | | | | | |
| 3727 | 1673 | F1.0ISYM97_ITS1F122 | 1557 | F1.0IUDYN_ITS1F621 | 25 | 37 | 22 | 12 | | | | | | | | | | | | | | | | | | | | |
| 3728 | 1515 | F1.0ISYM97_ITS1F131 | 1521 | F1.0IUDYN_ITS1F73 | 25 | 26 | 18 | 8 | | | | | | | | | | | | | | | | | | | | |
| 3729 | 1515 | F1.0ISYM97_ITS1F131 | 1605 | F1.0IUDYN_ITS1F6 | 39 | 32 | 26 | 16 | | | | | | | | | | | | | | | | 42 | 34 | 27 | 20 |
| 3730 | 1515 | F1.0ISYM97_ITS1F131 | 1521 | F1.0IUDYN_ITS1F73 | 39 | 26 | 22 | 13 | | | | | | | | | | | | | | | | 24 | 18 | 18 | 6 |
| 3731 | 1683 | F1.0ISYM97_ITS1F151 | 1574 | F1.0U97_ITS1F479 | 27 | 28 | 18 | 10 | | | | | | | | | | | | | | | | | | | | |
| 3732 | 1683 | F1.0ISYM97_ITS1F151 | 1605 | F1.0IUDYN_ITS1F6 | 27 | 32 | 21 | 11 | | | | | | | | | | | | | | | | | | | | |
| 3733 | 1683 | F1.0ISYM97_ITS1F151 | 1521 | F1.0IUDYN_ITS1F73 | 27 | 26 | 20 | 9 | 27 | 24 | 20 | 15 | | | | | | | | | 16 | 19 | 12 | 8 | | | | |
| 3734 | 1682 | F1.0ISYM97_ITS1F174 | 1574 | F1.0U97_ITS1F479 | 24 | 28 | 17 | 9 | | | | | | | | | | | | | | | | | | | | |
| 3735 | 1682 | F1.0ISYM97_ITS1F174 | 1573 | F1.0IUDYN_ITS1F60 | 24 | 27 | 17 | 8 | | | | | | | | | | | | | | | | | | | | |

TABLE 13-continued

| PAIR | Endophyte 1 (SEQ ID NO:) | Endophyte 1 (OUT) | Endophyte 2 (SEQ ID NO:) | Endophyte 2 (OTU) | F Fungi - cultivated | | | | G Fungi - cultivated, roots | | | | H Fungi - cultivated, seeds | | | | I Fungi - wild | | | | J Fungi - wild, roots | | | | K Fungi - wild, seeds | | | |
|---|---|---|---|---|---|---|---|---|---|---|---|---|---|---|---|---|---|---|---|---|---|---|---|---|---|---|---|---|
| | | | | | N1 | N2 | OC | EC | N1 | N2 | OC | EC | N1 | N2 | OC | EC | N1 | N2 | OC | EC | N1 | N2 | OC | EC | N1 | N2 | OC | EC |
| 3736 | 1682 | F1.0iSYM97_ITS1F74 | 1521 | F1.0iSYM97_ITS1F73 | 24 | 26 | 16 | 8 | | | | | | | | | | | | | | | | | | | | |
| 3737 | 1681 | F1.0iSYM97_ITS1F75 | 1605 | F1.0iSYM97_ITS1F6 | 19 | 32 | 17 | 8 | | | | | | | | | | | | | 15 | 17 | 11 | 7 | | | | |
| 3738 | 1681 | F1.0iSYM97_ITS1F75 | 1521 | F1.0iSYM97_ITS1F73 | 19 | 26 | 15 | 6 | | | | | | | | | | | | | 15 | 14 | 11 | 6 | | | | |
| 3739 | 1576 | F1.0iU97_ITS1F112 | 1576 | F1.0iUDYN_ITS1F112 | 12 | 21 | 12 | 3 | | | | | | | | | | | | | | | | | | | | |
| 3740 | 1591 | F1.0iU97_ITS1F3 | 1523 | F1.0iU97_ITS1F486 | 14 | 10 | 10 | 2 | | | | | 13 | 13 | 10 | 4 | | | | | | | | | | | | |
| 3741 | 1591 | F1.0iU97_ITS1F3 | 1591 | F1.0iUDYN_ITS1F3 | 14 | 16 | 14 | 3 | | | | | 13 | 15 | 13 | 6 | | | | | | | | | | | | |
| 3742 | 1595 | F1.0iU97_ITS1F38 | 1595 | F1.0iUDYN_ITS1F38 | 17 | 15 | 12 | 3 | | | | | | | | | | | | | | | | | | | | |
| 3743 | 1595 | F1.0iU97_ITS1F38 | 1605 | F1.0iUDYN_ITS1F6 | 17 | 32 | 16 | 7 | | | | | | | | | | | | | | | | | | | | |
| 3744 | 1574 | F1.0iU97_ITS1F479 | 1545 | F1.0iU97_ITS1F516 | 28 | 21 | 16 | 8 | | | | | | | | | | | | | | | | | | | | |
| 3745 | 1523 | F1.0iU97_ITS1F486 | 1591 | F1.0iUDYN_ITS1F3 | 10 | 16 | 10 | 2 | | | | | 10 | 15 | 10 | 4 | | | | | | | | | | | | |
| 3746 | 1591 | F1.0iU97_ITS1F3 | 1523 | F1.0iUDYN_ITS1F486 | 16 | 20 | 13 | 4 | | | | | 15 | 20 | 13 | 9 | | | | | | | | | | | | |
| 3747 | 1591 | F1.0iU97_ITS1F3 | 1581 | F1.0iUDYN_ITS1F84 | 16 | 25 | 14 | 5 | | | | | 15 | 23 | 14 | 10 | | | | | | | | | | | | |
| 3748 | 1575 | F1.0iU97_ITS1F37 | 1690 | F1.0iUDYN_ITS1F463 | 36 | 22 | 18 | 10 | | | | | | | | | | | | | | | | | | | | |
| 3749 | 1575 | F1.0iU97_ITS1F37 | 1605 | F1.0iUDYN_ITS1F6 | 36 | 32 | 24 | 15 | | | | | | | | | | | | | | | | | | | | |
| 3750 | 1575 | F1.0iU97_ITS1F37 | 1521 | F1.0iUDYN_ITS1F73 | 36 | 26 | 20 | 12 | | | | | | | | | | | | | | | | | | | | |
| 3751 | 1595 | F1.0iU97_ITS1F38 | 1595 | F1.0iUDYN_ITS1F38 | 15 | 32 | 14 | 6 | | | | | | | | | | | | | | | | | | | | |
| 3752 | 1690 | F1.0iU97_ITS1F463 | 1521 | F1.0iUDYN_ITS1F73 | 15 | 26 | 14 | 5 | 15 | 24 | 14 | 9 | | | | | | | | | | | | | | | | |
| 3753 | 1545 | F1.0iU97_ITS1F516 | 1557 | F1.0iUDYN_ITS1F621 | 22 | 37 | 23 | 11 | | | | | | | | | | | | | | | | | | | | |
| 3754 | 1605 | F1.0iU97_ITS1F6 | 1557 | F1.0iUDYN_ITS1F621 | 21 | 37 | 18 | 10 | | | | | | | | | | | | | | | | | | | | |
| 3755 | 1605 | F1.0iU97_ITS1F6 | 1521 | F1.0iUDYN_ITS1F73 | 32 | 37 | 24 | 15 | | | | | | | | | | | | | | | | | | | | |
| 3756 | 1557 | F1.0iU97_ITS1F621 | 1521 | F1.0iUDYN_ITS1F73 | 32 | 26 | 20 | 11 | | | | | | | | | | | | | | | | | | | | |
| 3757 | 1595 | F1.0iU97_ITS1F38 | 1595 | F1.0iUDYN_ITS1F38 | 37 | 26 | 21 | 13 | | | | | | | | | | | | | | | | | | | | |
| 3758 | 1654 | F1.0iU97_ITS1F264 | 1595 | F1.0iUDYN_ITS1F38 | | | | | 10 | 16 | 9 | 4 | | | | | | | | | | | | | | | | |
| 3759 | 1654 | F1.0iU97_ITS1F264 | 1521 | F1.0iUDYN_ITS1F73 | | | | | 10 | 15 | 9 | 4 | | | | | | | | | | | | | | | | |
| 3760 | 1514 | F1.0iU97_ITS1F369 | 1493 | F1.0iU97_ITS1F378 | | | | | 10 | 24 | 10 | 6 | | | | | | | | | | | | | | | | |
| 3761 | 1514 | F1.0iSYM97_ITS1F369 | 1569 | F1.0iUDYN_ITS1F455 | | | | | 13 | 18 | 11 | 6 | | | | | | | | | | | | | | | | |
| 3762 | 1575 | F1.0iU97_ITS1F37 | 1493 | F1.0iUDYN_ITS1F378 | | | | | 13 | 7 | 7 | 2 | | | | | | | | | | | | | | | | |
| 3763 | 1529 | F1.0iU97_ITS1F80 | 1529 | F1.0iUDYN_ITS1F80 | | | | | 13 | 18 | 10 | 6 | | | | | | | | | | | | | | | | |
| 3764 | 1591 | F1.0iU97_ITS1F3 | 1523 | F1.0iUDYN_ITS1F486 | | | | | 9 | 12 | 8 | 3 | | | | | | | | | | | | | | | | |
| 3765 | 1591 | F1.0iU97_ITS1F3 | 1581 | F1.0iUDYN_ITS1F84 | | | | | | | | | 13 | 20 | 11 | 7 | | | | | | | | | | | | |
| 3766 | 1587 | F1.0iUDYN_ITS1F1 | 1523 | F1.0iUDYN_ITS1F486 | | | | | | | | | 13 | 23 | 12 | 9 | | | | | | | | | | | | |
| 3767 | 1587 | F1.0iUDYN_ITS1F1 | 1581 | F1.0iUDYN_ITS1F84 | | | | | | | | | 27 | 20 | 19 | 15 | | | | | | | | | | | | |
| 3768 | 1586 | F1.0iUDYN_ITS1F110 | 1589 | F1.0iUDYN_ITS1F83 | | | | | | | | | 27 | 23 | 22 | 18 | | | | | | | | | | | | |
| 3769 | 1681 | F1.0iSYM97_ITS1F75 | 1576 | F1.0iUDYN_ITS1F112 | | | | | | | | | 13 | 11 | 9 | 4 | | | | | | | | | | | | |
| 3771 | 1531 | F1.0iSYM97_ITS1F112 | 1531 | F1.0iUDYN_ITS1F112 | | | | | | | | | | | | | | | | | 15 | 15 | 11 | 6 | 54 | 34 | 34 | 26 |
| 3772 | 1597 | F1.0iSYM97_ITS1F122 | 1605 | F1.0iUDYN_ITS1F6 | | | | | | | | | | | | | | | | | 7 | 9 | 6 | 2 | 16 | 25 | 13 | 6 |
| 3794 | 1629 | F1.0iU97_ITS1F603 | 1629 | F1.0iUDYN_ITS1F603 | | | | | | | | | | | | | | | | | 12 | 19 | 10 | 6 | | | | |
| 3822 | 1573 | F1.0iU97_ITS1F60 | 1521 | F1.0iUDYN_ITS1F73 | | | | | | | | | | | | | | | | | 9 | 7 | 7 | 2 | | | | |
| 3889 | 1596 | F1.0iU97_ITS1F508 | 1605 | F1.0iUDYN_ITS1F6 | | | | | | | | | | | | | | | | | 18 | 17 | 12 | 8 | | | | |
| 3899 | 1605 | F1.0iU97_ITS1F6 | 1592 | F1.0iUDYN_ITS1F627 | | | | | | | | | | | | | | | | | | | | | 24 | 20 | 15 | 7 |
| 3900 | 1592 | F1.0iU97_ITS1F627 | 1581 | F1.0iUDYN_ITS1F84 | | | | | | | | | | | | | | | | | | | | | 20 | 18 | 15 | 5 |
| 3904 | 1518 | F1.0iU97_ITS1F502 | 1518 | F1.0iUDYN_ITS1F502 | | | | | | | | | | | | | | | | | | | | | 18 | 34 | 16 | 9 |
| 3907 | 1518 | F1.0iU97_ITS1F502 | 1628 | F1.0iUDYN_ITS1F77 | | | | | | | | | | | | | | | | | | | | | 13 | 18 | 12 | 3 |
| 3908 | 1655 | F1.0iU97_ITS1F628 | 1488 | F1.0iUDYN_ITS1F550 | | | | | | | | | | | | | 37 | 24 | 21 | 8 | | | | | 13 | 20 | 12 | 4 |
| 3909 | 1628 | F1.0iU97_ITS1F77 | 1518 | F1.0iUDYN_ITS1F502 | | | | | | | | | | | | | 21 | 18 | 15 | 4 | | | | | 36 | 24 | 21 | 12 |
| 3910 | | | 1518 | F1.0iUDYN_ITS1F502 | | | | | | | | | | | | | | | | | | | | | 21 | 18 | 15 | 5 |

TABLE 13-continued

| A | B | C | D | E | F Fungi - cultivated | | | | G Fungi - cultivated, roots | | | | H Fungi - cultivated, seeds | | | | I Fungi - wild | | | | J Fungi - wild, roots | | | | K Fungi - wild, seeds | | | |
|---|---|---|---|---|---|---|---|---|---|---|---|---|---|---|---|---|---|---|---|---|---|---|---|---|---|---|---|---|
| PAIR | Endophyte 1 (SEQ ID NO:) | Endophyte 1 (OTU) | Endophyte 2 (SEQ ID NO:) | Endophyte 2 (OTU) | N1 | N2 | OC | EC | N1 | N2 | OC | EC | N1 | N2 | OC | EC | N1 | N2 | OC | EC | N1 | N2 | OC | EC | N1 | N2 | OC | EC |
| 3911 | 1628 | F1.0UDYN_ITS1F77 | 1628 | F1.0UDYN_ITS1F77 | | | | | | | | | | | | | 21 | 20 | 19 | 4 | | | | | 21 | 20 | 19 | 6 |
| 3912 | 1594 | F1.0UDYN_ITS1F198 | 1585 | F1.0UDYN_ITS1F367 | | | | | | | | | | | | | | | | | | | | | 13 | 12 | 11 | 2 |
| 3913 | 1518 | F1.0UDYN_ITS1F502 | 1628 | F1.0UDYN_ITS1F77 | | | | | | | | | | | | | | | | | | | | | 18 | 20 | 15 | 5 |
| 3933 | 1635 | F1.0U97_ITS1F426 | 1655 | F1.0U97_ITS1F628 | | | | | | | | | | | | | 18 | 20 | 15 | 3 | | | | | 20 | 36 | 19 | 10 |
| 3934 | 1635 | F1.0U97_ITS1F426 | 1628 | F1.0UDYN_ITS1F77 | | | | | | | | | | | | | 20 | 37 | 19 | 7 | | | | | 20 | 21 | 15 | 6 |
| 3935 | 1635 | F1.0U97_ITS1F426 | 1494 | F1.0UDYN_ITS1F494 | | | | | | | | | | | | | 20 | 21 | 15 | 4 | | | | | 20 | 17 | 14 | 5 |
| 3936 | 1635 | F1.0U97_ITS1F426 | 1488 | F1.0UDYN_ITS1F550 | | | | | | | | | | | | | 20 | 17 | 14 | 3 | | | | | 20 | 24 | 16 | 7 |
| 3937 | 1655 | F1.0U97_ITS1F628 | 1628 | F1.0UDYN_ITS1F77 | | | | | | | | | | | | | 20 | 24 | 16 | 4 | | | | | 36 | 21 | 18 | 11 |
| 3938 | 1655 | F1.0U97_ITS1F628 | 1672 | F1.0UDYN_ITS1F451 | | | | | | | | | | | | | 37 | 21 | 18 | 7 | | | | | | | | |
| 3939 | 1655 | F1.0U97_ITS1F628 | 1655 | F1.0U97_ITS1F628 | | | | | | | | | | | | | 37 | 72 | 36 | 24 | | | | | | | | |
| 3940 | 1655 | F1.0U97_ITS1F628 | 1655 | F1.0U97_ITS1F628 | | | | | | | | | | | | | 37 | 67 | 36 | 23 | | | | | 36 | 20 | 18 | 10 |
| 3941 | 1533 | F1.0U97_ITS1F458 | 1655 | F1.0U97_ITS1F628 | | | | | | | | | | | | | 37 | 20 | 18 | 7 | | | | | | | | |
| 3942 | 1493 | F1.0U97_ITS1F378 | 1607 | F1.0U97_ITS1F400 | | | | | | | | | | | | | 29 | 67 | 29 | 18 | | | | | | | | |
| 3943 | 1629 | F1.0U97_ITS1F603 | 1545 | F1.0U97_ITS1F516 | | | | | | | | | | | | | | | | | | | | | | | | |
| 3944 | 1587 | F1.0UDYN_ITS1F1 | 1545 | F1.0U97_ITS1F516 | | | | | | | | | | | | | | | | | | | | | | | | |
| 3945 | 1653 | F1.0SYM97_ITS1F67 | 1628 | F1.0UDYN_ITS1F77 | | | | | | | | | | | | | | | | | 10 | 8 | 6 | 2 | 12 | 21 | 11 | 4 |
| 3946 | 1653 | F1.0SYM97_ITS1F67 | 1628 | F1.0UDYN_ITS1F77 | | | | | | | | | | | | | | | | | 9 | 20 | 9 | 5 | 12 | 20 | 12 | 3 |
| 3947 | 1487 | F1.0U97_ITS1F371 | 1487 | F1.0U97_ITS1F371 | | | | | | | | | | | | | | | | | 24 | 20 | 17 | 13 | 11 | 16 | 10 | 2 |
| 3948 | 1635 | F1.0U97_ITS1F426 | 1518 | F1.0U97_ITS1F502 | | | | | | | | | | | | | | | | | | | | | 20 | 13 | 11 | 4 |
| 3949 | 1635 | F1.0U97_ITS1F426 | 1518 | F1.0U97_ITS1F502 | | | | | | | | | | | | | | | | | | | | | 20 | 18 | 14 | 5 |
| 3950 | 1635 | F1.0U97_ITS1F426 | 1628 | F1.0UDYN_ITS1F77 | | | | | | | | | | | | | | | | | | | | | 20 | 20 | 14 | 4 |
| 3951 | 1518 | F1.0U97_ITS1F502 | 1628 | F1.0UDYN_ITS1F77 | | | | | | | | | | | | | | | | | | | | | 13 | 21 | 12 | 4 |
| 3952 | 1518 | F1.0U97_ITS1F502 | 1526 | F1.0U97_ITS1F305 | | | | | | | | | | | | | | | | | | | | | 13 | 15 | 11 | 3 |
| 3953 | 1518 | F1.0U97_ITS1F502 | 1494 | F1.0UDYN_ITS1F494 | | | | | | | | | | | | | | | | | | | | | 13 | 17 | 11 | 3 |
| 3954 | 1655 | F1.0U97_ITS1F628 | 1494 | F1.0UDYN_ITS1F494 | | | | | | | | | | | | | | | | | | | | | 36 | 17 | 16 | 9 |
| 3955 | 1628 | F1.0UDYN_ITS1F77 | 1526 | F1.0U97_ITS1F305 | | | | | | | | | | | | | | | | | | | | | 21 | 15 | 12 | 4 |
| 3956 | 1628 | F1.0UDYN_ITS1F77 | 1494 | F1.0UDYN_ITS1F494 | | | | | | | | | | | | | | | | | | | | | 21 | 17 | 14 | 5 |
| 3957 | 1628 | F1.0UDYN_ITS1F77 | 1588 | F1.0UDYN_ITS1F638 | | | | | | | | | | | | | | | | | | | | | 21 | 14 | 13 | 4 |
| 3958 | 1526 | F1.0U97_ITS1F305 | 1494 | F1.0UDYN_ITS1F494 | | | | | | | | | | | | | | | | | | | | | 15 | 17 | 11 | 4 |
| 3959 | 1526 | F1.0U97_ITS1F305 | 1518 | F1.0U97_ITS1F502 | | | | | | | | | | | | | | | | | | | | | 15 | 18 | 12 | 4 |
| 3960 | 1523 | F1.0UDYN_ITS1F486 | 1628 | F1.0UDYN_ITS1F77 | | | | | | | | | | | | | | | | | | | | | 15 | 20 | 12 | 4 |
| 3961 | 1518 | F1.0UDYN_ITS1F6 | 1605 | F1.0UDYN_ITS1F6 | | | | | | | | | | | | | | | | | | | | | 42 | 20 | 19 | 12 |
| 3962 | 1494 | F1.0UDYN_ITS1F494 | 1518 | F1.0U97_ITS1F502 | | | | | | | | | | | | | | | | | | | | | 17 | 18 | 13 | 4 |
| 3963 | 1494 | F1.0UDYN_ITS1F494 | 1488 | F1.0UDYN_ITS1F550 | | | | | | | | | | | | | | | | | | | | | 17 | 24 | 13 | 6 |
| 3964 | 1494 | F1.0UDYN_ITS1F494 | 1521 | F1.0UDYN_ITS1F73 | | | | | | | | | | | | | | | | | | | | | 17 | 14 | 12 | 3 |
| 3965 | 1494 | F1.0UDYN_ITS1F494 | 1628 | F1.0UDYN_ITS1F77 | | | | | | | | | | | | | | | | | | | | | 17 | 20 | 13 | 5 |
| 3966 | 1518 | F1.0U97_ITS1F502 | 1588 | F1.0UDYN_ITS1F638 | | | | | | | | | | | | | | | | | | | | | 18 | 14 | 11 | 4 |
| 3967 | 1588 | F1.0UDYN_ITS1F638 | 1628 | F1.0UDYN_ITS1F77 | | | | | | | | | | | | | | | | | | | | | 14 | 20 | 12 | 4 |
| 3968 | 1630 | F1.0UDYN_ITS1F68 | 1628 | F1.0UDYN_ITS1F77 | | | | | | | | | | | | | | | | | | | | | 14 | 20 | 12 | 4 |

Table 14: Pairs of Endophytes Useful for the Present Invention, as Identified by Co-Occurrence Analysis of Various Plant Samples.

Column A shows the pair number. Columns B and C show the SEQ ID NO: and OTU designation for endophyte 1 of a pair. Columns D and E show the SEQ ID NO: and OTU designation for endophyte 2 of a pair. Columns F, G, H, I, J, and K show the number of times microbes belonging to OTU1 occur in a sample (N1), the number of times microbes belonging to OTU2 occur in a sample (N2), the number of times the microbes co-occur in all the plant samples of the collection or a subgroup of those plant samples (OC), and the number of times microbes of those OTUs would be expected to co-occur (EC). In this table, "Bacteria—dicots" represents a co-occurrence analysis using all dicot plant samples of the collection, to identify bacteria that co-occur in these samples. "Bacteria—dicots, roots" represents a co-occurrence analysis using only root samples from the dicot plant samples of the collection, to identify bacteria that co-occur in these samples. "Bacteria—dicots, seeds" represents a co-occurrence analysis using only seed samples from the dicot plant samples of the collection, to identify bacteria that co-occur in these samples. "Fungi—dicots" represents a co-occurrence analysis using all dicot plant samples of the collection, to identify fungi that co-occur in these samples. "Fungi—dicots, roots" represents a co-occurrence analysis using only root samples from the dicot plant samples of the collection, to identify fungi that co-occur in these samples. "Fungi—dicots, seeds" represents a co-occurrence analysis using only seed samples from the dicot plant samples of the collection, to identify fungi that co-occur in these samples.

TABLE 14

| PAIR | B SEQ ID | C Endophyte 1 (OTU) | D SEQ ID | E Endophyte 2 (OTU) | F Bacteria - dicots | | | | G Bacteria - dicots, roots | | | | H Bacteria - dicots, seeds | | | | I Fungi - dicots | | | | J Fungi - dicots, roots | | | | K Fungi - dicots, seeds | | | |
|---|---|---|---|---|---|---|---|---|---|---|---|---|---|---|---|---|---|---|---|---|---|---|---|---|---|---|---|---|
| | | | | | N1 | N2 | OC | EC | N1 | N2 | OC | EC | N1 | N2 | OC | EC | N1 | N2 | OC | EC | N1 | N2 | OC | EC | N1 | N2 | OC | EC |
| 1 | 1108 | B1.0|REF97_V4|1 | 1110 | B1.0|REF99_V4|108549 | | | | | | | | | 16 | 18 | 14 | 4 | | | | | | | | | | | | |
| 3 | 1108 | B1.0|REF97_V4|1 | 1093 | B1.0|REF99_V4|429 | | | | | | | | | 16 | 20 | 14 | 5 | | | | | | | | | | | | |
| 13 | 1089 | B1.0|REF97_V4|127 | 1095 | B1.0|REF99_V4|154497 | 31 | 22 | 19 | 6 | | | | | 24 | 22 | 19 | 8 | | | | | | | | | | | | |
| 15 | 1191 | B1.0|REF97_V4|150716 | 1191 | B1.0|REF99_V4|150716 | 22 | 27 | 21 | 6 | | | | | 22 | 27 | 21 | 9 | | | | | | | | | | | | |
| 16 | 1191 | B1.0|REF97_V4|150716 | 972 | B1.0|REF99_V4|218 | 22 | 34 | 18 | 7 | | | | | 22 | 34 | 18 | 11 | | | | | | | | | | | | |
| 17 | 1191 | B1.0|REF97_V4|150716 | 957 | B1.0|REF99_V4|921 | | | | | | | | | 22 | 27 | 16 | 9 | | | | | | | | | | | | |
| 18 | 1011 | B1.0|REF97_V4|2104 | 974 | B1.0|REF99_V4|2831 | 28 | 37 | 28 | 10 | | | | | | | | | | | | | | | | | | | | |
| 19 | 1011 | B1.0|REF97_V4|2104 | 916 | B1.0|REF99_V4|3675 | 28 | 33 | 25 | 9 | | | | | | | | | | | | | | | | | | | | |
| 20 | 1011 | B1.0|REF97_V4|2104 | 959 | B1.0|REF99_V4|4126 | 28 | 32 | 25 | 8 | | | | | | | | | | | | | | | | | | | | |
| 21 | 1011 | B1.0|REF97_V4|2104 | 1011 | B1.0|REF99_V4|2104 | 28 | 32 | 27 | 8 | | | | | | | | | | | | | | | | | | | | |
| 22 | 1011 | B1.0|REF97_V4|2104 | 789 | B1.0|REF99_V4|2172 | 28 | 38 | 27 | 10 | | | | | | | | | | | | | | | | | | | | |
| 23 | 1011 | B1.0|REF97_V4|2104 | 974 | B1.0|REF99_V4|2831 | 28 | 37 | 28 | 10 | | | | | | | | | | | | | | | | | | | | |
| 24 | 1011 | B1.0|REF97_V4|2104 | 916 | B1.0|REF99_V4|3675 | 28 | 37 | 28 | 10 | | | | | | | | | | | | | | | | | | | | |
| 25 | 1011 | B1.0|REF97_V4|2104 | 1012 | B1.0|REF99_V4|597 | 28 | 34 | 26 | 9 | | | | | | | | | | | | | | | | | | | | |
| 26 | 1011 | B1.0|REF97_V4|2104 | 713 | B1.0|REF99_V4|754 | 28 | 37 | 26 | 10 | | | | | | | | | | | | | | | | | | | | |
| 27 | 1011 | B1.0|REF97_V4|2104 | 915 | B1.0|REF99_V4|884 | 28 | 33 | 25 | 9 | | | | | | | | | | | | | | | | | | | | |
| 28 | 1011 | B1.0|REF97_V4|2104 | 1007 | B1.0|REF99_V4|9526 | 28 | 39 | 25 | 10 | | | | | | | | | | | | | | | | | | | | |
| 29 | 974 | B1.0|REF97_V4|2831 | 615 | B1.0|REF99_V4|3374 | 37 | 26 | 26 | 9 | | | | | | | | | | | | | | | | | | | | |
| 30 | 974 | B1.0|REF97_V4|2831 | 916 | B1.0|REF99_V4|3675 | 37 | 33 | 33 | 11 | | | | | | | | | | | | | | | | | | | | |
| 31 | 974 | B1.0|REF97_V4|2831 | 837 | B1.0|REF99_V4|4720 | 37 | 31 | 29 | 11 | | | | | | | | | | | | | | | | | | | | |
| 32 | 974 | B1.0|REF97_V4|2831 | 1007 | B1.0|REF99_V4|9526 | 37 | 31 | 30 | 11 | | | | | | | | | | | | | | | | | | | | |
| 33 | 974 | B1.0|REF97_V4|2831 | 137 | B1.0|REF99_V4|11 | 37 | 48 | 37 | 17 | | | | | | | | | | | | | | | | | | | | |
| 34 | 974 | B1.0|REF97_V4|2831 | 884 | B1.0|REF99_V4|1164 | 37 | 31 | 31 | 11 | | | | | | | | | | | | | | | | | | | | |
| 35 | 974 | B1.0|REF97_V4|2831 | 959 | B1.0|REF99_V4|4126 | 37 | 32 | 32 | 11 | | | | | | | | | | | | | | | | | | | | |
| 36 | 974 | B1.0|REF97_V4|2831 | 886 | B1.0|REF99_V4|1287 | 37 | 22 | 21 | 8 | | | | | | | | | | | | | | | | | | | | |
| 37 | 974 | B1.0|REF97_V4|2831 | 71 | B1.0|REF99_V4|1351 | 37 | 34 | 34 | 12 | | | | | | | | | | | | | | | | | | | | |
| 38 | 974 | B1.0|REF97_V4|2831 | 648 | B1.0|REF99_V4|414 | 37 | 54 | 37 | 19 | | | | | | | | | | | | | | | | | | | | |
| 39 | 974 | B1.0|REF97_V4|2831 | 739 | B1.0|REF99_V4|1562 | 37 | 28 | 26 | 10 | | | | | | | | | | | | | | | | | | | | |
| 40 | 974 | B1.0|REF97_V4|2831 | 116 | B1.0|REF99_V4|1567 | 37 | 29 | 26 | 10 | | | | | | | | | | | | | | | | | | | | |
| 41 | 974 | B1.0|REF97_V4|2831 | 1180 | B1.0|REF99_V4|4166 | 37 | 49 | 33 | 17 | | | | | | | | | | | | | | | | | | | | |
| 42 | 974 | B1.0|REF97_V4|2831 | 889 | B1.0|REF99_V4|4185 | 37 | 28 | 22 | 10 | | | | | | | | | | | | | | | | | | | | |
| 43 | 974 | B1.0|REF97_V4|2831 | 656 | B1.0|REF99_V4|4191 | 37 | 38 | 31 | 13 | | | | | | | | | | | | | | | | | | | | |
| 44 | 974 | B1.0|REF97_V4|2831 | 1011 | B1.0|REF99_V4|2104 | 37 | 37 | 32 | 11 | | | | | | | | | | | | | | | | | | | | |
| 45 | 974 | B1.0|REF97_V4|2831 | 789 | B1.0|REF99_V4|2172 | 37 | 32 | 32 | 11 | | | | | | | | | | | | | | | | | | | | |
| 46 | 974 | B1.0|REF97_V4|2831 | 789 | B1.0|REF99_V4|12385 | 37 | 38 | 35 | 13 | | | | | | | | | | | | | | | | | | | | |
| 47 | 974 | B1.0|REF97_V4|2831 | 683 | B1.0|REF99_V4|12385 | 37 | 20 | 20 | 7 | | | | | | | | | | | | | | | | | | | | |
| 48 | 974 | B1.0|REF97_V4|2831 | 810 | B1.0|REF99_V4|4250 | 37 | 26 | 26 | 9 | | | | | | | | | | | | | | | | | | | | |
| 49 | 974 | B1.0|REF97_V4|2831 | 131 | B1.0|REF99_V4|4251 | 37 | 30 | 27 | 10 | | | | | | | | | | | | | | | | | | | | |
| 50 | 974 | B1.0|REF97_V4|2831 | 943 | B1.0|REF99_V4|126030 | 37 | 30 | 30 | 10 | | | | | | | | | | | | | | | | | | | | |
| 51 | 974 | B1.0|REF97_V4|2831 | 974 | B1.0|REF99_V4|2831 | 37 | 37 | 37 | 13 | | | | | | | | | | | | | | | | | | | | |
| 52 | 974 | B1.0|REF97_V4|2831 | 615 | B1.0|REF99_V4|13374 | 37 | 37 | 32 | 11 | | | | | | | | | | | | | | | | | | | | |
| 53 | 974 | B1.0|REF97_V4|2831 | 963 | B1.0|REF99_V4|133855 | 37 | 36 | 33 | 12 | | | | | | | | | | | | | | | | | | | | |
| 54 | 974 | B1.0|REF97_V4|2831 | 961 | B1.0|REF99_V4|3580 | 37 | 23 | 23 | 8 | | | | | | | | | | | | | | | | | | | | |
| 55 | 974 | B1.0|REF97_V4|2831 | 916 | B1.0|REF99_V4|3675 | 37 | 37 | 37 | 13 | | | | | | | | | | | | | | | | | | | | |
| 56 | 974 | B1.0|REF97_V4|2831 | 945 | B1.0|REF99_V4|4442 | 37 | 26 | 26 | 9 | | | | | | | | | | | | | | | | | | | | |

TABLE 14-continued

| A PAIR | B Endophyte 1 (SEQ ID) | C Endophyte 1 (OTU) | D Endophyte 2 (SEQ ID) | E Endophyte 2 (OTU) | F Bacteria - dicots | | | | G Bacteria - dicots, roots | | | | H Bacteria - dicots, seeds | | | | I Fungi - dicots | | | | J Fungi - dicots, roots | | | | K Fungi - dicots, seeds | | | |
|---|---|---|---|---|---|---|---|---|---|---|---|---|---|---|---|---|---|---|---|---|---|---|---|---|---|---|---|---|
| | | | | | N1 | N2 | OC | EC | N1 | N2 | OC | EC | N1 | N2 | OC | EC | N1 | N2 | OC | EC | N1 | N2 | OC | EC | N1 | N2 | OC | EC |
| 58 | 974 | B1.0|REF97_V4|2831 | 69 | B1.0|REF99_V4|506 | 37 | 31 | 29 | 11 | | | | | | | | | | | | | | | | | | | | |
| 59 | 974 | B1.0|REF97_V4|2831 | 60 | B1.0|REF99_V4|514 | 37 | 22 | 22 | 8 | | | | | | | | | | | | | | | | | | | | |
| 60 | 974 | B1.0|REF97_V4|2831 | 1012 | B1.0|REF99_V4|597 | 37 | 34 | 34 | 12 | | | | | | | | | | | | | | | | | | | | |
| 61 | 974 | B1.0|REF97_V4|2831 | 319 | B1.0|REF99_V4|70731 | 37 | 25 | 25 | 9 | | | | | | | | | | | | | | | | | | | | |
| 62 | 974 | B1.0|REF97_V4|2831 | 837 | B1.0|REF99_V4|720 | 37 | 47 | 37 | 16 | | | | | | | | | | | | | | | | | | | | |
| 63 | 974 | B1.0|REF97_V4|2831 | 713 | B1.0|REF99_V4|754 | 37 | 37 | 35 | 13 | | | | | | | | | | | | | | | | | | | | |
| 64 | 974 | B1.0|REF97_V4|2831 | 915 | B1.0|REF99_V4|884 | 37 | 33 | 33 | 11 | | | | | | | | | | | | | | | | | | | | |
| 65 | 974 | B1.0|REF97_V4|2831 | 1007 | B1.0|REF99_V4|9526 | 37 | 39 | 34 | 14 | | | | | | | | | | | | | | | | | | | | |
| 66 | 974 | B1.0|REF97_V4|3374 | 959 | B1.0|REF99_V4|126 | 26 | 32 | 23 | 8 | | | | | | | | | | | | | | | | | | | | |
| 67 | 615 | B1.0|REF97_V4|3374 | 71 | B1.0|REF99_V4|1351 | 26 | 34 | 24 | 8 | | | | | | | | | | | | | | | | | | | | |
| 68 | 615 | B1.0|REF97_V4|3374 | 1011 | B1.0|REF99_V4|2104 | 26 | 32 | 24 | 8 | | | | | | | | | | | | | | | | | | | | |
| 69 | 615 | B1.0|REF97_V4|3374 | 974 | B1.0|REF99_V4|2831 | 26 | 37 | 26 | 9 | | | | | | | | | | | | | | | | | | | | |
| 70 | 615 | B1.0|REF97_V4|3374 | 615 | B1.0|REF99_V4|3374 | 26 | 32 | 25 | 8 | | | | | | | | | | | | | | | | | | | | |
| 71 | 615 | B1.0|REF97_V4|3374 | 916 | B1.0|REF99_V4|3675 | 26 | 37 | 26 | 9 | | | | | | | | | | | | | | | | | | | | |
| 72 | 615 | B1.0|REF97_V4|3374 | 1012 | B1.0|REF99_V4|597 | 26 | 34 | 24 | 8 | | | | | | | | | | | | | | | | | | | | |
| 73 | 615 | B1.0|REF97_V4|3374 | 1007 | B1.0|REF99_V4|9526 | 26 | 39 | 25 | 10 | | | | | | | | | | | | | | | | | | | | |
| 74 | 615 | B1.0|REF97_V4|3374 | 837 | B1.0|REF99_V4|720 | 26 | 37 | 26 | 9 | | | | | | | | | | | | | | | | | | | | |
| 75 | 916 | B1.0|REF97_V4|3675 | 1007 | B1.0|REF99_V4|9526 | 33 | 31 | 26 | 10 | | | | | | | | | | | | | | | | | | | | |
| 76 | 916 | B1.0|REF97_V4|3675 | 137 | B1.0|REF99_V4|411 | 33 | 48 | 33 | 15 | | | | | | | | | | | | | | | | | | | | |
| 77 | 916 | B1.0|REF97_V4|3675 | 884 | B1.0|REF99_V4|11164 | 33 | 31 | 27 | 10 | | | | | | | | | | | | | | | | | | | | |
| 78 | 916 | B1.0|REF97_V4|3675 | 959 | B1.0|REF99_V4|126 | 33 | 32 | 28 | 10 | | | | | | | | | | | | | | | | | | | | |
| 79 | 916 | B1.0|REF97_V4|3675 | 886 | B1.0|REF99_V4|1287 | 33 | 22 | 21 | 7 | | | | | | | | | | | | | | | | | | | | |
| 80 | 916 | B1.0|REF97_V4|3675 | 71 | B1.0|REF99_V4|1351 | 33 | 34 | 30 | 11 | | | | | | | | | | | | | | | | | | | | |
| 81 | 916 | B1.0|REF97_V4|3675 | 648 | B1.0|REF99_V4|414 | 33 | 54 | 33 | 17 | | | | | | | | | | | | | | | | | | | | |
| 82 | 916 | B1.0|REF97_V4|3675 | 116 | B1.0|REF99_V4|1567 | 33 | 29 | 24 | 9 | | | | | | | | | | | | | | | | | | | | |
| 83 | 916 | B1.0|REF97_V4|3675 | 1171 | B1.0|REF99_V4|11639 | 33 | 16 | 16 | 5 | | | | | | | | | | | | | | | | | | | | |
| 84 | 916 | B1.0|REF97_V4|3675 | 656 | B1.0|REF99_V4|191 | 33 | 38 | 27 | 12 | | | | | | | | | | | | | | | | | | | | |
| 85 | 916 | B1.0|REF97_V4|3675 | 1011 | B1.0|REF99_V4|2104 | 33 | 32 | 28 | 10 | | | | | | | | | | | | | | | | | | | | |
| 86 | 916 | B1.0|REF97_V4|3675 | 789 | B1.0|REF99_V4|2172 | 33 | 38 | 31 | 12 | | | | | | | | | | | | | | | | | | | | |
| 87 | 916 | B1.0|REF97_V4|3675 | 810 | B1.0|REF99_V4|250 | 33 | 26 | 22 | 8 | | | | | | | | | | | | | | | | | | | | |
| 88 | 916 | B1.0|REF97_V4|3675 | 131 | B1.0|REF99_V4|251 | 33 | 30 | 24 | 9 | | | | | | | | | | | | | | | | | | | | |
| 89 | 916 | B1.0|REF97_V4|3675 | 943 | B1.0|REF99_V4|426030 | 33 | 30 | 28 | 9 | | | | | | | | | | | | | | | | | | | | |
| 90 | 916 | B1.0|REF97_V4|3675 | 974 | B1.0|REF99_V4|2831 | 33 | 37 | 33 | 11 | | | | | | | | | | | | | | | | | | | | |
| 91 | 916 | B1.0|REF97_V4|3675 | 615 | B1.0|REF99_V4|3374 | 33 | 32 | 28 | 10 | | | | | | | | | | | | | | | | | | | | |
| 92 | 916 | B1.0|REF97_V4|3675 | 963 | B1.0|REF99_V4|33855 | 33 | 36 | 29 | 11 | | | | | | | | | | | | | | | | | | | | |
| 93 | 916 | B1.0|REF97_V4|3675 | 916 | B1.0|REF99_V4|3675 | 33 | 37 | 33 | 11 | | | | | | | | | | | | | | | | | | | | |
| 94 | 916 | B1.0|REF97_V4|3675 | 945 | B1.0|REF99_V4|442 | 33 | 26 | 25 | 8 | | | | | | | | | | | | | | | | | | | | |
| 96 | 916 | B1.0|REF97_V4|3675 | 69 | B1.0|REF99_V4|506 | 33 | 31 | 25 | 10 | | | | | | | | | | | | | | | | | | | | |
| 97 | 916 | B1.0|REF97_V4|3675 | 1012 | B1.0|REF99_V4|597 | 33 | 34 | 30 | 11 | | | | | | | | | | | | | | | | | | | | |
| 98 | 916 | B1.0|REF97_V4|3675 | 319 | B1.0|REF99_V4|70731 | 33 | 25 | 23 | 8 | | | | | | | | | | | | | | | | | | | | |
| 99 | 916 | B1.0|REF97_V4|3675 | 837 | B1.0|REF99_V4|720 | 33 | 47 | 33 | 15 | | | | | | | | | | | | | | | | | | | | |
| 100 | 916 | B1.0|REF97_V4|3675 | 713 | B1.0|REF99_V4|754 | 33 | 37 | 31 | 12 | | | | | | | | | | | | | | | | | | | | |
| 101 | 916 | B1.0|REF97_V4|3675 | 915 | B1.0|REF99_V4|884 | 33 | 33 | 29 | 11 | | | | | | | | | | | | | | | | | | | | |
| 102 | 916 | B1.0|REF97_V4|3675 | 1007 | B1.0|REF99_V4|9526 | 33 | 39 | 30 | 10 | | | | | | | | | | | | | | | | | | | | |
| 103 | 1106 | B1.0|REF97_V4|66 | 1094 | B1.0|REF99_V4|387 | 37 | 22 | 19 | 8 | | | | | | | | | | | | | | | | | | | | |
| 105 | 837 | B1.0|REF97_V4|720 | 1007 | B1.0|REF99_V4|9526 | 31 | 31 | 24 | 9 | | | | | | | | | | | | | | | | | | | | |

TABLE 14-continued

| A PAIR | B Endophyte 1 (SEQ ID) | C Endophyte 1 (OTU) | D Endophyte 2 (SEQ ID) | E Endophyte 2 (OTU) | F Bacteria - dicots | | | | G Bacteria - dicots, roots | | | | H Bacteria - dicots, seeds | | | | I Fungi - dicots | | | | J Fungi - dicots, roots | | | | K Fungi - dicots, seeds | | | |
|---|---|---|---|---|---|---|---|---|---|---|---|---|---|---|---|---|---|---|---|---|---|---|---|---|---|---|---|---|
| | | | | | N1 | N2 | OC | EC | N1 | N2 | OC | EC | N1 | N2 | OC | EC | N1 | N2 | OC | EC | N1 | N2 | OC | EC | N1 | N2 | OC | EC |
| 106 | 837 | B1.0|REF97_V4|720 | 137 | B1.0|REF99_V4|11 | 31 | 48 | 29 | 14 | | | | | | | | | | | | | | | | | | | | |
| 107 | 837 | B1.0|REF97_V4|720 | 884 | B1.0|REF99_V4|1164 | 31 | 31 | 25 | 9 | | | | | | | | | | | | | | | | | | | | |
| 108 | 837 | B1.0|REF97_V4|720 | 959 | B1.0|REF99_V4|126 | 31 | 32 | 24 | 9 | | | | | | | | | | | | | | | | | | | | |
| 109 | 837 | B1.0|REF97_V4|720 | 71 | B1.0|REF99_V4|1351 | 31 | 34 | 26 | 10 | | | | | | | | | | | | | | | | | | | | |
| 110 | 837 | B1.0|REF97_V4|720 | 1011 | B1.0|REF99_V4|2104 | 31 | 32 | 26 | 9 | | | | | | | | | | | | | | | | | | | | |
| 111 | 837 | B1.0|REF97_V4|720 | 789 | B1.0|REF99_V4|2172 | 31 | 38 | 29 | 11 | | | | | | | | | | | | | | | | | | | | |
| 112 | 837 | B1.0|REF97_V4|720 | 810 | B1.0|REF99_V4|250 | 31 | 26 | 21 | 8 | | | | | | | | | | | | | | | | | | | | |
| 113 | 837 | B1.0|REF97_V4|720 | 943 | B1.0|REF99_V4|26030 | 31 | 30 | 23 | 9 | | | | | | | | | | | | | | | | | | | | |
| 114 | 837 | B1.0|REF97_V4|720 | 974 | B1.0|REF99_V4|2831 | 31 | 37 | 29 | 11 | | | | | | | | | | | | | | | | | | | | |
| 115 | 837 | B1.0|REF97_V4|720 | 615 | B1.0|REF99_V4|3374 | 31 | 32 | 25 | 9 | | | | | | | | | | | | | | | | | | | | |
| 116 | 837 | B1.0|REF97_V4|720 | 963 | B1.0|REF99_V4|33855 | 31 | 36 | 27 | 10 | | | | | | | | | | | | | | | | | | | | |
| 117 | 837 | B1.0|REF97_V4|720 | 916 | B1.0|REF99_V4|3675 | 31 | 37 | 29 | 11 | | | | | | | | | | | | | | | | | | | | |
| 118 | 837 | B1.0|REF97_V4|720 | 1012 | B1.0|REF99_V4|4597 | 31 | 34 | 26 | 10 | | | | | | | | | | | | | | | | | | | | |
| 119 | 837 | B1.0|REF97_V4|720 | 837 | B1.0|REF99_V4|4720 | 31 | 47 | 31 | 14 | | | | | | | | | | | | | | | | | | | | |
| 120 | 837 | B1.0|REF97_V4|720 | 713 | B1.0|REF99_V4|4754 | 31 | 37 | 27 | 11 | | | | | | | | | | | | | | | | | | | | |
| 121 | 837 | B1.0|REF97_V4|720 | 915 | B1.0|REF99_V4|4884 | 31 | 33 | 27 | 10 | | | | | | | | | | | | | | | | | | | | |
| 122 | 837 | B1.0|REF97_V4|720 | 1007 | B1.0|REF99_V4|49526 | 31 | 39 | 28 | 11 | | | | | | | | | | | | | | | | | | | | |
| 123 | 510 | B1.0|REF97_V4|8981 | 510 | B1.0|REF99_V4|8981 | 14 | 22 | 14 | 3 | | | | | 14 | 20 | 14 | 4 | | | | | | | | | | | | |
| 124 | 1007 | B1.0|REF97_V4|9526 | 137 | B1.0|REF99_V4|11 | 31 | 48 | 31 | 14 | | | | | | | | | | | | | | | | | | | | |
| 125 | 1007 | B1.0|REF97_V4|9526 | 884 | B1.0|REF99_V4|1164 | 31 | 31 | 25 | 9 | | | | | | | | | | | | | | | | | | | | |
| 126 | 1007 | B1.0|REF97_V4|9526 | 959 | B1.0|REF99_V4|126 | 31 | 32 | 25 | 9 | | | | | | | | | | | | | | | | | | | | |
| 127 | 1007 | B1.0|REF97_V4|9526 | 71 | B1.0|REF99_V4|1351 | 31 | 34 | 27 | 10 | | | | | | | | | | | | | | | | | | | | |
| 128 | 1007 | B1.0|REF97_V4|9526 | 1011 | B1.0|REF99_V4|2104 | 31 | 32 | 26 | 9 | | | | | | | | | | | | | | | | | | | | |
| 129 | 1007 | B1.0|REF97_V4|9526 | 789 | B1.0|REF99_V4|2172 | 31 | 38 | 28 | 11 | | | | | | | | | | | | | | | | | | | | |
| 130 | 1007 | B1.0|REF97_V4|9526 | 943 | B1.0|REF99_V4|26030 | 31 | 30 | 26 | 9 | | | | | | | | | | | | | | | | | | | | |
| 131 | 1007 | B1.0|REF97_V4|9526 | 974 | B1.0|REF99_V4|2831 | 31 | 37 | 30 | 11 | | | | | | | | | | | | | | | | | | | | |
| 132 | 1007 | B1.0|REF97_V4|9526 | 615 | B1.0|REF99_V4|3374 | 31 | 32 | 27 | 9 | | | | | | | | | | | | | | | | | | | | |
| 133 | 1007 | B1.0|REF97_V4|9526 | 916 | B1.0|REF99_V4|3675 | 31 | 37 | 30 | 11 | | | | | | | | | | | | | | | | | | | | |
| 134 | 1007 | B1.0|REF97_V4|9526 | 1012 | B1.0|REF99_V4|4597 | 31 | 34 | 27 | 10 | | | | | | | | | | | | | | | | | | | | |
| 135 | 1007 | B1.0|REF97_V4|9526 | 837 | B1.0|REF99_V4|4720 | 31 | 47 | 31 | 14 | | | | | | | | | | | | | | | | | | | | |
| 136 | 1007 | B1.0|REF97_V4|9526 | 1007 | B1.0|REF99_V4|49526 | 31 | 39 | 28 | 11 | | | | | | | | | | | | | | | | | | | | |
| 137 | 372 | B1.0|REF99_V4|10206 | 881 | B1.0|REF99_V4|4434 | 27 | 29 | 18 | 7 | | | | | | | | | | | | | | | | | | | | |
| 138 | 1110 | B1.0|REF99_V4|108549 | 1097 | B1.0|REF99_V4|159716 | | | | | | | | | | | | | | | | | | | | | | | |
| 139 | 1110 | B1.0|REF99_V4|108549 | 1086 | B1.0|REF99_V4|25794 | | | | | | | | | | | | | | | | | | | | | | | |
| 141 | 1110 | B1.0|REF99_V4|108549 | 1093 | B1.0|REF99_V4|429 | | | | | | | | | | | | | | | | | | | | | | | |
| 143 | 137 | B1.0|REF99_V4|11 | 884 | B1.0|REF99_V4|1164 | 48 | 31 | 31 | 14 | | | | | 26 | 28 | 18 | 10 | | | | | | | | | | | | |
| 144 | 137 | B1.0|REF99_V4|11 | 959 | B1.0|REF99_V4|126 | 48 | 32 | 32 | 14 | | | | | 18 | 13 | 11 | 3 | | | | | | | | | | | | |
| 145 | 137 | B1.0|REF99_V4|11 | 71 | B1.0|REF99_V4|1351 | 48 | 34 | 34 | 15 | | | | | 18 | 21 | 13 | 5 | | | | | | | | | | | | |
| 146 | 137 | B1.0|REF99_V4|11 | 116 | B1.0|REF99_V4|1567 | 48 | 29 | 27 | 13 | | | | | 18 | 20 | 14 | 5 | | | | | | | | | | | | |
| 147 | 137 | B1.0|REF99_V4|11 | 1180 | B1.0|REF99_V4|4166 | 48 | 49 | 37 | 22 | | | | | | | | | | | | | | | | | | | | |
| 148 | 137 | B1.0|REF99_V4|11 | 656 | B1.0|REF99_V4|4191 | 48 | 38 | 34 | 17 | | | | | | | | | | | | | | | | | | | | |
| 149 | 137 | B1.0|REF99_V4|11 | 1011 | B1.0|REF99_V4|2104 | 48 | 32 | 32 | 14 | | | | | | | | | | | | | | | | | | | | |
| 150 | 137 | B1.0|REF99_V4|11 | 789 | B1.0|REF99_V4|2172 | 48 | 38 | 34 | 17 | | | | | | | | | | | | | | | | | | | | |
| 151 | 137 | B1.0|REF99_V4|11 | 810 | B1.0|REF99_V4|250 | 48 | 26 | 26 | 12 | | | | | | | | | | | | | | | | | | | | |
| 152 | 137 | B1.0|REF99_V4|11 | 943 | B1.0|REF99_V4|26030 | 48 | 30 | 30 | 14 | | | | | | | | | | | | | | | | | | | | |
| 153 | 137 | B1.0|REF99_V4|11 | 974 | B1.0|REF99_V4|2831 | 48 | 37 | 37 | 17 | | | | | | | | | | | | | | | | | | | | |

TABLE 14-continued

| A PAIR | B Endophyte 1 (SEQ ID) | C Endophyte 1 (OTU) | D Endophyte 2 (SEQ ID) | E Endophyte 2 (OTU) | F Bacteria - dicots N1 | F N2 | F OC | F EC | G Bacteria - dicots, roots N1 | G N2 | G OC | G EC | H Bacteria - dicots, seeds N1 | H N2 | H OC | H EC | I Fungi - dicots N1 | I N2 | I OC | I EC | J Fungi - dicots, roots N1 | J N2 | J OC | J EC | K Fungi - dicots, seeds N1 | K N2 | K OC | K EC |
|---|---|---|---|---|---|---|---|---|---|---|---|---|---|---|---|---|---|---|---|---|---|---|---|---|---|---|---|---|
| 156 | 137 | B1.0|REF99_V4|11 | 615 | B1.0|REF99_V4|3374 | 48 | 32 | 32 | 14 | | | | | | | | | | | | | | | | | | | | |
| 157 | 137 | B1.0|REF99_V4|11 | 963 | B1.0|REF99_V4|33855 | 48 | 36 | 35 | 16 | | | | | | | | | | | | | | | | | | | | |
| 158 | 137 | B1.0|REF99_V4|11 | 916 | B1.0|REF99_V4|3675 | 48 | 37 | 37 | 17 | | | | | | | | | | | | | | | | | | | | |
| 159 | 137 | B1.0|REF99_V4|11 | 69 | B1.0|REF99_V4|506 | 48 | 31 | 30 | 14 | | | | | | | | | | | | | | | | | | | | |
| 160 | 137 | B1.0|REF99_V4|11 | 1012 | B1.0|REF99_V4|597 | 48 | 34 | 34 | 15 | | | | | | | | | | | | | | | | | | | | |
| 161 | 137 | B1.0|REF99_V4|11 | 837 | B1.0|REF99_V4|720 | 48 | 47 | 38 | 21 | | | | | | | | | | | | | | | | | | | | |
| 162 | 137 | B1.0|REF99_V4|11 | 713 | B1.0|REF99_V4|754 | 48 | 37 | 35 | 17 | | | | | | | | | | | | | | | | | | | | |
| 163 | 137 | B1.0|REF99_V4|11 | 915 | B1.0|REF99_V4|884 | 48 | 33 | 33 | 15 | | | | | | | | | | | | | | | | | | | | |
| 164 | 137 | B1.0|REF99_V4|11 | 1007 | B1.0|REF99_V4|9526 | 48 | 39 | 37 | 18 | | | | | | | | | | | | | | | | | | | | |
| 165 | 884 | B1.0|REF99_V4|164 | 959 | B1.0|REF99_V4|126 | 31 | 32 | 28 | 9 | | | | | | | | | | | | | | | | | | | | |
| 166 | 884 | B1.0|REF99_V4|164 | 71 | B1.0|REF99_V4|1351 | 31 | 34 | 28 | 10 | | | | | | | | | | | | | | | | | | | | |
| 167 | 884 | B1.0|REF99_V4|164 | 1011 | B1.0|REF99_V4|2104 | 31 | 32 | 27 | 9 | | | | | | | | | | | | | | | | | | | | |
| 168 | 884 | B1.0|REF99_V4|164 | 789 | B1.0|REF99_V4|2172 | 31 | 38 | 30 | 11 | | | | | | | | | | | | | | | | | | | | |
| 169 | 884 | B1.0|REF99_V4|164 | 810 | B1.0|REF99_V4|250 | 31 | 26 | 22 | 8 | | | | | | | | | | | | | | | | | | | | |
| 170 | 884 | B1.0|REF99_V4|164 | 943 | B1.0|REF99_V4|26030 | 31 | 30 | 25 | 9 | | | | | | | | | | | | | | | | | | | | |
| 171 | 884 | B1.0|REF99_V4|164 | 974 | B1.0|REF99_V4|2831 | 31 | 32 | 31 | 11 | | | | | | | | | | | | | | | | | | | | |
| 172 | 884 | B1.0|REF99_V4|164 | 615 | B1.0|REF99_V4|3374 | 31 | 32 | 27 | 9 | | | | | | | | | | | | | | | | | | | | |
| 173 | 884 | B1.0|REF99_V4|164 | 916 | B1.0|REF99_V4|3675 | 31 | 37 | 31 | 11 | | | | | | | | | | | | | | | | | | | | |
| 174 | 884 | B1.0|REF99_V4|164 | 1012 | B1.0|REF99_V4|597 | 31 | 34 | 30 | 10 | | | | | | | | | | | | | | | | | | | | |
| 175 | 884 | B1.0|REF99_V4|164 | 837 | B1.0|REF99_V4|720 | 31 | 47 | 31 | 14 | | | | | | | | | | | | | | | | | | | | |
| 176 | 884 | B1.0|REF99_V4|164 | 1007 | B1.0|REF99_V4|9526 | 31 | 39 | 29 | 11 | | | | | | | | | | | | | | | | | | | | |
| 177 | 959 | B1.0|REF99_V4|126 | 71 | B1.0|REF99_V4|1351 | 32 | 34 | 29 | 10 | | | | | | | | | | | | | | | | | | | | |
| 178 | 959 | B1.0|REF99_V4|126 | 648 | B1.0|REF99_V4|414 | 32 | 54 | 32 | 16 | | | | | | | | | | | | | | | | | | | | |
| 179 | 959 | B1.0|REF99_V4|126 | 116 | B1.0|REF99_V4|1567 | 32 | 29 | 24 | 9 | | | | | | | | | | | | | | | | | | | | |
| 180 | 959 | B1.0|REF99_V4|126 | 1180 | B1.0|REF99_V4|166 | 32 | 49 | 30 | 15 | | | | | | | | | | | | | | | | | | | | |
| 181 | 959 | B1.0|REF99_V4|126 | 656 | B1.0|REF99_V4|191 | 32 | 38 | 26 | 11 | | | | | | | | | | | | | | | | | | | | |
| 182 | 959 | B1.0|REF99_V4|126 | 1011 | B1.0|REF99_V4|2104 | 32 | 32 | 28 | 10 | | | | | | | | | | | | | | | | | | | | |
| 183 | 959 | B1.0|REF99_V4|126 | 789 | B1.0|REF99_V4|2172 | 32 | 38 | 30 | 11 | | | | | | | | | | | | | | | | | | | | |
| 184 | 959 | B1.0|REF99_V4|126 | 810 | B1.0|REF99_V4|250 | 32 | 26 | 23 | 8 | | | | | | | | | | | | | | | | | | | | |
| 185 | 959 | B1.0|REF99_V4|126 | 131 | B1.0|REF99_V4|251 | 32 | 30 | 24 | 9 | | | | | | | | | | | | | | | | | | | | |
| 186 | 959 | B1.0|REF99_V4|126 | 943 | B1.0|REF99_V4|26030 | 32 | 30 | 26 | 9 | | | | | | | | | | | | | | | | | | | | |
| 187 | 959 | B1.0|REF99_V4|126 | 974 | B1.0|REF99_V4|2831 | 32 | 37 | 32 | 11 | | | | | | | | | | | | | | | | | | | | |
| 188 | 959 | B1.0|REF99_V4|126 | 615 | B1.0|REF99_V4|3374 | 32 | 32 | 27 | 11 | | | | | | | | | | | | | | | | | | | | |
| 189 | 959 | B1.0|REF99_V4|126 | 963 | B1.0|REF99_V4|33855 | 32 | 36 | 28 | 11 | | | | | | | | | | | | | | | | | | | | |
| 190 | 959 | B1.0|REF99_V4|126 | 961 | B1.0|REF99_V4|3580 | 32 | 23 | 23 | 7 | | | | | | | | | | | | | | | | | | | | |
| 191 | 959 | B1.0|REF99_V4|126 | 916 | B1.0|REF99_V4|3675 | 32 | 37 | 32 | 11 | | | | | | | | | | | | | | | | | | | | |
| 192 | 959 | B1.0|REF99_V4|126 | 945 | B1.0|REF99_V4|4442 | 32 | 26 | 24 | 8 | | | | | | | | | | | | | | | | | | | | |
| 193 | 959 | B1.0|REF99_V4|126 | 69 | B1.0|REF99_V4|506 | 32 | 31 | 25 | 9 | | | | | | | | | | | | | | | | | | | | |
| 194 | 959 | B1.0|REF99_V4|126 | 1012 | B1.0|REF99_V4|597 | 32 | 34 | 30 | 10 | | | | | | | | | | | | | | | | | | | | |
| 195 | 959 | B1.0|REF99_V4|126 | 837 | B1.0|REF99_V4|720 | 32 | 47 | 32 | 14 | | | | | | | | | | | | | | | | | | | | |
| 196 | 959 | B1.0|REF99_V4|126 | 713 | B1.0|REF99_V4|754 | 32 | 37 | 31 | 11 | | | | | | | | | | | | | | | | | | | | |
| 197 | 959 | B1.0|REF99_V4|126 | 915 | B1.0|REF99_V4|884 | 32 | 33 | 29 | 10 | | | | | | | | | | | | | | | | | | | | |
| 198 | 959 | B1.0|REF99_V4|126 | 1007 | B1.0|REF99_V4|9526 | 22 | 39 | 29 | 12 | | | | | | | | | | | | | | | | | | | | |
| 199 | 886 | B1.0|REF99_V4|1287 | 974 | B1.0|REF99_V4|2831 | 22 | 37 | 21 | 8 | | | | | | | | | | | | | | | | | | | | |
| 200 | 886 | B1.0|REF99_V4|1287 | 916 | B1.0|REF99_V4|3675 | 22 | 37 | 21 | 8 | | | | | | | | | | | | | | | | | | | | |
| 201 | 939 | B1.0|REF99_V4|1317 | 1012 | B1.0|REF99_V4|597 | 31 | 34 | 26 | 10 | | | | | | | | | | | | | | | | | | | | |

TABLE 14-continued

| A PAIR | B Endophyte 1 (SEQ ID) | C Endophyte 1 (OTU) | D Endophyte 2 (SEQ ID) | E Endophyte 2 (OTU) | F Bacteria - dicots N1 | F N2 | F OC | F EC | G Bacteria - dicots, roots N1 | G N2 | G OC | G EC | H Bacteria - dicots, seeds N1 | H N2 | H OC | H EC | I Fungi - dicots N1 | I N2 | I OC | I EC | J Fungi - dicots, roots N1 | J N2 | J OC | J EC | K Fungi - dicots, seeds N1 | K N2 | K OC | K EC |
|---|---|---|---|---|---|---|---|---|---|---|---|---|---|---|---|---|---|---|---|---|---|---|---|---|---|---|---|---|
| 205 | 71 | B1.0IREF99_V41351 | 116 | B1.0IREF99_V41567 | 34 | 29 | 24 | 9 | | | | | | | | | | | | | | | | | | | | |
| 206 | 71 | B1.0IREF99_V41351 | 1011 | B1.0IREF99_V42104 | 34 | 32 | 29 | 10 | | | | | | | | | | | | | | | | | | | | |
| 207 | 71 | B1.0IREF99_V41351 | 789 | B1.0IREF99_V42172 | 34 | 38 | 32 | 12 | | | | | | | | | | | | | | | | | | | | |
| 208 | 71 | B1.0IREF99_V41351 | 810 | B1.0IREF99_V4250 | 34 | 26 | 23 | 8 | | | | | | | | | | | | | | | | | | | | |
| 209 | 71 | B1.0IREF99_V41351 | 131 | B1.0IREF99_V41251 | 34 | 30 | 25 | 10 | | | | | | | | | | | | | | | | | | | | |
| 210 | 71 | B1.0IREF99_V41351 | 943 | B1.0IREF99_V426030 | 34 | 30 | 28 | 10 | | | | | | | | | | | | | | | | | | | | |
| 211 | 71 | B1.0IREF99_V41351 | 974 | B1.0IREF99_V42831 | 34 | 37 | 34 | 12 | | | | | | | | | | | | | | | | | | | | |
| 212 | 71 | B1.0IREF99_V41351 | 615 | B1.0IREF99_V43374 | 34 | 32 | 30 | 10 | | | | | | | | | | | | | | | | | | | | |
| 213 | 71 | B1.0IREF99_V41351 | 963 | B1.0IREF99_V433855 | 34 | 36 | 31 | 11 | | | | | | | | | | | | | | | | | | | | |
| 214 | 71 | B1.0IREF99_V41351 | 916 | B1.0IREF99_V43675 | 34 | 37 | 34 | 12 | | | | | | | | | | | | | | | | | | | | |
| 216 | 71 | B1.0IREF99_V41351 | 69 | B1.0IREF99_V41506 | 34 | 31 | 27 | 10 | | | | | | | | | | | | | | | | | | | | |
| 217 | 71 | B1.0IREF99_V41351 | 1012 | B1.0IREF99_V41597 | 34 | 34 | 31 | 11 | | | | | | | | | | | | | | | | | | | | |
| 218 | 71 | B1.0IREF99_V41351 | 837 | B1.0IREF99_V41720 | 34 | 47 | 34 | 15 | | | | | | | | | | | | | | | | | | | | |
| 219 | 71 | B1.0IREF99_V41351 | 713 | B1.0IREF99_V41754 | 34 | 37 | 33 | 12 | | | | | | | | | | | | | | | | | | | | |
| 220 | 71 | B1.0IREF99_V41351 | 915 | B1.0IREF99_V41884 | 34 | 33 | 31 | 11 | | | | | | | | | | | | | | | | | | | | |
| 221 | 71 | B1.0IREF99_V41351 | 1007 | B1.0IREF99_V49526 | 34 | 39 | 31 | 12 | | | | | | | | | | | | | | | | | | | | |
| 222 | 648 | B1.0IREF99_V414 | 1180 | B1.0IREF99_V41166 | 54 | 49 | 41 | 25 | | | | | | | | | | | | | | | | | | | | |
| 223 | 648 | B1.0IREF99_V414 | 974 | B1.0IREF99_V42831 | 54 | 37 | 37 | 19 | | | | | | | | | | | | | | | | | | | | |
| 224 | 648 | B1.0IREF99_V414 | 916 | B1.0IREF99_V43675 | 54 | 37 | 37 | 19 | | | | | | | | | | | | | | | | | | | | |
| 225 | 648 | B1.0IREF99_V414 | 1012 | B1.0IREF99_V41597 | 54 | 37 | 34 | 17 | | | | | | | | | | | | | | | | | | | | |
| 226 | 648 | B1.0IREF99_V414 | 713 | B1.0IREF99_V41754 | 54 | 37 | 36 | 19 | | | | | | | | | | | | | | | | | | | | |
| 227 | 648 | B1.0IREF99_V414 | 1007 | B1.0IREF99_V49526 | 54 | 39 | 36 | 20 | | | | | | | | | | | | | | | | | | | | |
| 230 | 1112 | B1.0IREF99_V414460 | 1094 | B1.0IREF99_V41387 | | | | | | | | | | | | | | | | | | | | | | | | |
| 231 | 1112 | B1.0IREF99_V414460 | 1095 | B1.0IREF99_V454497 | 30 | 22 | 17 | 6 | | | | | | | | | | | | | | | | | | | | |
| 233 | 1091 | B1.0IREF99_V415 | 1077 | B1.0IREF99_V4209 | | | | | | | | | | | | | | | | | | | | | | | | |
| 234 | 1091 | B1.0IREF99_V415 | 1086 | B1.0IREF99_V4125794 | 20 | 21 | 15 | 4 | | | | | | | | | | | | | | | | | | | | |
| 236 | 1191 | B1.0IREF99_V4150716 | 972 | B1.0IREF99_V4218 | 27 | 34 | 20 | 9 | | | | | | | | | | | | | | | | | | | | |
| 237 | 1191 | B1.0IREF99_V4150716 | 1163 | B1.0IREF99_V416806 | 27 | 31 | 22 | 8 | | | | | | | | | | | | | | | | | | | | |
| 242 | 739 | B1.0IREF99_V41562 | 974 | B1.0IREF99_V42831 | 28 | 37 | 26 | 10 | | | | | | | | | | | | | | | | | | | | |
| 243 | 739 | B1.0IREF99_V41562 | 916 | B1.0IREF99_V43675 | 28 | 37 | 26 | 10 | | | | | | | | | | | | | | | | | | | | |
| 244 | 739 | B1.0IREF99_V41562 | 1012 | B1.0IREF99_V41597 | 28 | 34 | 25 | 9 | | | | | | | | | | | | | | | | | | | | |
| 245 | 116 | B1.0IREF99_V41567 | 1011 | B1.0IREF99_V42104 | 29 | 32 | 22 | 9 | | 30 | 15 | 14 | 6 | | | | | | | | | | | | | | | |
| 246 | 116 | B1.0IREF99_V41567 | 789 | B1.0IREF99_V42172 | 29 | 38 | 27 | 10 | | 30 | 22 | 17 | 9 | | | | | | | | | | | | | | | |
| 247 | 116 | B1.0IREF99_V41567 | 810 | B1.0IREF99_V4250 | 29 | 26 | 19 | 7 | | 19 | 17 | 12 | 5 | | | | | | | | | | | | | | | |
| 248 | 116 | B1.0IREF99_V41567 | 943 | B1.0IREF99_V426030 | 29 | 30 | 21 | 8 | | 19 | 21 | 15 | 6 | | | | | | | | | | | | | | | |
| 249 | 116 | B1.0IREF99_V41567 | 974 | B1.0IREF99_V42831 | 29 | 37 | 26 | 10 | | 27 | 31 | 22 | 12 | | | | | | | | | | | | | | | |
| 250 | 116 | B1.0IREF99_V41567 | 615 | B1.0IREF99_V43374 | 29 | 32 | 21 | 9 | | | | | | | | | | | | | | | | | | | | | |
| 251 | 116 | B1.0IREF99_V41567 | 916 | B1.0IREF99_V43675 | 29 | 37 | 26 | 10 | | | | | | | | | | | | | | | | | | | | | |
| 253 | 116 | B1.0IREF99_V41567 | 69 | B1.0IREF99_V41506 | 28 | 31 | 22 | 8 | | | | | | | | | | | | | | | | | | | | | |
| 254 | 116 | B1.0IREF99_V41567 | 1012 | B1.0IREF99_V41597 | 29 | 34 | 23 | 9 | | | | | | | | | | | | | | | | | | | | | |
| 255 | 116 | B1.0IREF99_V41567 | 837 | B1.0IREF99_V41720 | 29 | 47 | 27 | 13 | | | | | | | | | | | | | | | | | | | | | |
| 256 | 116 | B1.0IREF99_V41567 | 713 | B1.0IREF99_V41754 | 29 | 37 | 27 | 10 | | | | | | | | | | | | | | | | | | | | | |
| 257 | 116 | B1.0IREF99_V41567 | 915 | B1.0IREF99_V41884 | 29 | 33 | 24 | 9 | | | | | | | | | | | | | | | | | | | | | |
| 258 | 116 | B1.0IREF99_V41567 | 1007 | B1.0IREF99_V49526 | 29 | 39 | 26 | 11 | | 13 | 21 | 12 | 4 | | | | | | | | | | | | | | | |
| 259 | 1097 | B1.0IREF99_V4159716 | 1086 | B1.0IREF99_V4125794 | | | | | | | | | | | | | | | | | | | | | | | | |
| 263 | 1180 | B1.0IREF99_V41166 | 974 | B1.0IREF99_V42831 | 49 | 37 | 33 | 17 | | | | | | | | | | | | | | | | | | | | | |

TABLE 14-continued

| A | B | C | D | E | F Bacteria - dicots | | | | G Bacteria - dicots, roots | | | | H Bacteria - dicots, seeds | | | | I Fungi - dicots | | | | J Fungi - dicots, roots | | | | K Fungi - dicots, seeds | | | |
|---|---|---|---|---|---|---|---|---|---|---|---|---|---|---|---|---|---|---|---|---|---|---|---|---|---|---|---|---|
| PAIR | Endophyte 1 (SEQ ID) | Endophyte 1 (OTU) | Endophyte 2 (SEQ ID) | Endophyte 2 (OTU) | N1 | N2 | OC | EC | N1 | N2 | OC | EC | N1 | N2 | OC | EC | N1 | N2 | OC | EC | N1 | N2 | OC | EC | N1 | N2 | OC | EC |
| 264 | 1180 | B1.0|REF99_V4|166 | 916 | B1.0|REF99_V4|3675 | 49 | 37 | 33 | 17 | | | | | | | | | | | | | | | | | | | | |
| 265 | 1180 | B1.0|REF99_V4|166 | 1012 | B1.0|REF99_V4|597 | 49 | 34 | 31 | 16 | | | | | | | | | | | | | | | | | | | | |
| 269 | 889 | B1.0|REF99_V4|185 | 789 | B1.0|REF99_V4|2172 | 28 | 38 | 22 | 10 | | | | | | | | | | | | | | | | | | | | |
| 270 | 889 | B1.0|REF99_V4|185 | 974 | B1.0|REF99_V4|2831 | 28 | 37 | 22 | 10 | | | | | | | | | | | | | | | | | | | | |
| 271 | 889 | B1.0|REF99_V4|185 | 916 | B1.0|REF99_V4|3675 | 28 | 37 | 22 | 10 | | | | | | | | | | | | | | | | | | | | |
| 272 | 889 | B1.0|REF99_V4|185 | 1012 | B1.0|REF99_V4|597 | 28 | 34 | 21 | 9 | | | | | | | | | | | | | | | | | | | | |
| 275 | 656 | B1.0|REF99_V4|191 | 789 | B1.0|REF99_V4|2172 | 38 | 38 | 32 | 14 | | | | | | | | | | | | | | | | | | | | |
| 276 | 656 | B1.0|REF99_V4|191 | 974 | B1.0|REF99_V4|2831 | 38 | 37 | 31 | 13 | | | | | | | | | | | | | | | | | | | | |
| 277 | 656 | B1.0|REF99_V4|191 | 916 | B1.0|REF99_V4|3675 | 38 | 37 | 31 | 13 | | | | | | | | | | | | | | | | | | | | |
| 278 | 656 | B1.0|REF99_V4|191 | 1012 | B1.0|REF99_V4|597 | 38 | 34 | 29 | 12 | | | | | | | | | | | | | | | | | | | | |
| 279 | 656 | B1.0|REF99_V4|191 | 837 | B1.0|REF99_V4|4720 | 38 | 47 | 32 | 17 | | | | | | | | | | | | | | | | | | | | |
| 280 | 656 | B1.0|REF99_V4|191 | 713 | B1.0|REF99_V4|4754 | 38 | 37 | 30 | 13 | | | | | | | | | | | | | | | | | | | | |
| 281 | 656 | B1.0|REF99_V4|191 | 915 | B1.0|REF99_V4|4884 | 38 | 33 | 28 | 12 | | | | | | | | | | | | | | | | | | | | |
| 282 | 656 | B1.0|REF99_V4|191 | 1007 | B1.0|REF99_V4|9526 | 38 | 39 | 31 | 14 | | | | | | | | | | | | | | | | | | | | |
| 283 | 1195 | B1.0|REF99_V4|1916 | 881 | B1.0|REF99_V4|4434 | 17 | 29 | 16 | 5 | | | | | 17 | 28 | 16 | 7 | | | | | | | | | | | | |
| 286 | 1011 | B1.0|REF99_V4|2104 | 789 | B1.0|REF99_V4|2172 | 32 | 38 | 31 | 11 | | | | | | | | | | | | | | | | | | | | |
| 287 | 1011 | B1.0|REF99_V4|2104 | 810 | B1.0|REF99_V4|250 | 32 | 26 | 22 | 8 | | | | | | | | | | | | | | | | | | | | |
| 288 | 1011 | B1.0|REF99_V4|2104 | 131 | B1.0|REF99_V4|251 | 32 | 30 | 23 | 9 | | | | | | | | | | | | | | | | | | | | |
| 289 | 1011 | B1.0|REF99_V4|2104 | 943 | B1.0|REF99_V4|26030 | 32 | 30 | 27 | 9 | | | | | | | | | | | | | | | | | | | | |
| 290 | 1011 | B1.0|REF99_V4|2104 | 974 | B1.0|REF99_V4|2831 | 32 | 37 | 32 | 11 | | | | | | | | | | | | | | | | | | | | |
| 291 | 1011 | B1.0|REF99_V4|2104 | 615 | B1.0|REF99_V4|3374 | 32 | 32 | 29 | 10 | | | | | | | | | | | | | | | | | | | | |
| 292 | 1011 | B1.0|REF99_V4|2104 | 963 | B1.0|REF99_V4|33855 | 32 | 36 | 29 | 11 | | | | | | | | | | | | | | | | | | | | |
| 293 | 1011 | B1.0|REF99_V4|2104 | 916 | B1.0|REF99_V4|3675 | 32 | 37 | 32 | 11 | | | | | | | | | | | | | | | | | | | | |
| 295 | 1011 | B1.0|REF99_V4|2104 | 69 | B1.0|REF99_V4|506 | 32 | 31 | 26 | 9 | | | | | | | | | | | | | | | | | | | | |
| 296 | 1011 | B1.0|REF99_V4|2104 | 1012 | B1.0|REF99_V4|597 | 32 | 34 | 29 | 10 | | | | | | | | | | | | | | | | | | | | |
| 297 | 1011 | B1.0|REF99_V4|2104 | 837 | B1.0|REF99_V4|4720 | 32 | 47 | 32 | 14 | | | | | | | | | | | | | | | | | | | | |
| 298 | 1011 | B1.0|REF99_V4|2104 | 713 | B1.0|REF99_V4|4754 | 32 | 37 | 30 | 11 | | | | | | | | | | | | | | | | | | | | |
| 299 | 1011 | B1.0|REF99_V4|2104 | 915 | B1.0|REF99_V4|4884 | 32 | 33 | 29 | 10 | | | | | | | | | | | | | | | | | | | | |
| 300 | 1011 | B1.0|REF99_V4|2104 | 1007 | B1.0|REF99_V4|9526 | 32 | 39 | 29 | 12 | | | | | | | | | | | | | | | | | | | | |
| 301 | 789 | B1.0|REF99_V4|2172 | 810 | B1.0|REF99_V4|250 | 38 | 26 | 25 | 9 | | | | | | | | | | | | | | | | | | | | |
| 303 | 789 | B1.0|REF99_V4|2172 | 131 | B1.0|REF99_V4|251 | 38 | 30 | 26 | 11 | | | | | | | | | | | | | | | | | | | | |
| 304 | 789 | B1.0|REF99_V4|2172 | 943 | B1.0|REF99_V4|26030 | 38 | 30 | 28 | 11 | | | | | | | | | | | | | | | | | | | | |
| 305 | 789 | B1.0|REF99_V4|2172 | 974 | B1.0|REF99_V4|2831 | 38 | 37 | 35 | 13 | | | | | | | | | | | | | | | | | | | | |
| 306 | 789 | B1.0|REF99_V4|2172 | 615 | B1.0|REF99_V4|3374 | 38 | 32 | 30 | 11 | | | | | | | | | | | | | | | | | | | | |
| 307 | 789 | B1.0|REF99_V4|2172 | 963 | B1.0|REF99_V4|33855 | 38 | 36 | 33 | 13 | | | | | | | | | | | | | | | | | | | | |
| 308 | 789 | B1.0|REF99_V4|2172 | 916 | B1.0|REF99_V4|3675 | 38 | 37 | 35 | 11 | | | | | | | | | | | | | | | | | | | | |
| 309 | 789 | B1.0|REF99_V4|2172 | 69 | B1.0|REF99_V4|506 | 38 | 31 | 28 | 11 | | | | | | | | | | | | | | | | | | | | |
| 310 | 789 | B1.0|REF99_V4|2172 | 1012 | B1.0|REF99_V4|597 | 38 | 34 | 32 | 12 | | | | | | | | | | | | | | | | | | | | |
| 311 | 789 | B1.0|REF99_V4|2172 | 837 | B1.0|REF99_V4|4720 | 38 | 47 | 35 | 17 | | | | | | | | | | | | | | | | | | | | |
| 312 | 789 | B1.0|REF99_V4|2172 | 713 | B1.0|REF99_V4|4754 | 38 | 37 | 35 | 13 | | | | | | | | | | | | | | | | | | | | |
| 313 | 789 | B1.0|REF99_V4|2172 | 915 | B1.0|REF99_V4|4884 | 38 | 33 | 32 | 12 | | | | | | | | | | | | | | | | | | | | |
| 314 | 789 | B1.0|REF99_V4|2172 | 1007 | B1.0|REF99_V4|9526 | 38 | 39 | 34 | 14 | | | | | | | | | | | | | | | | | | | | |
| 315 | 972 | B1.0|REF99_V4|218 | 957 | B1.0|REF99_V4|921 | 34 | 30 | 21 | 10 | | | | | | | | | | | | | | | | | | | | |
| 316 | 681 | B1.0|REF99_V4|234 | 837 | B1.0|REF99_V4|4720 | 41 | 47 | 34 | 18 | | | | | 34 | 27 | 21 | 13 | | | | | | | | | | | | |
| 317 | 683 | B1.0|REF99_V4|2385 | 974 | B1.0|REF99_V4|2831 | 20 | 37 | 20 | 7 | | | | | | | | | | | | | | | | | | | | |
| 318 | 683 | B1.0|REF99_V4|2385 | 1012 | B1.0|REF99_V4|597 | 20 | 34 | 20 | 6 | | | | | | | | | | | | | | | | | | | | |

TABLE 14-continued

| PAIR | Endophyte 1 (SEQ ID) | Endophyte 1 (OTU) | Endophyte 2 (SEQ ID) | Endophyte 2 (OTU) | F Bacteria - dicots N1 | N2 | OC | EC | G Bacteria - dicots, roots N1 | N2 | OC | EC | H Bacteria - dicots, seeds N1 | N2 | OC | EC | I Fungi - dicots N1 | N2 | OC | EC | J Fungi - dicots, roots N1 | N2 | OC | EC | K Fungi - dicots, seeds N1 | N2 | OC | EC |
|---|---|---|---|---|---|---|---|---|---|---|---|---|---|---|---|---|---|---|---|---|---|---|---|---|---|---|---|---|
| 319 | 810 | B1.0|REF99_V4|250 | 943 | B1.0|REF99_V4|26030 | 26 | 30 | 20 | 7 | | | | | | | | | | | | | | | | | | | | |
| 320 | 810 | B1.0|REF99_V4|250 | 974 | B1.0|REF99_V4|2831 | 26 | 37 | 26 | 9 | | | | | | | | | | | | | | | | | | | | |
| 321 | 810 | B1.0|REF99_V4|250 | 615 | B1.0|REF99_V4|3374 | 26 | 32 | 22 | 8 | | | | | | | | | | | | | | | | | | | | |
| 322 | 810 | B1.0|REF99_V4|250 | 916 | B1.0|REF99_V4|3675 | 26 | 37 | 26 | 9 | | | | | | | | | | | | | | | | | | | | |
| 323 | 810 | B1.0|REF99_V4|250 | 1012 | B1.0|REF99_V4|597 | 26 | 34 | 24 | 8 | | | | | | | | | | | | | | | | | | | | |
| 324 | 810 | B1.0|REF99_V4|250 | 837 | B1.0|REF99_V4|720 | 26 | 47 | 25 | 8 | | | | | | | | | | | | | | | | | | | | |
| 325 | 810 | B1.0|REF99_V4|250 | 713 | B1.0|REF99_V4|754 | 26 | 37 | 25 | 9 | | | | | | | | | | | | | | | | | | | | |
| 326 | 810 | B1.0|REF99_V4|250 | 915 | B1.0|REF99_V4|4884 | 26 | 33 | 23 | 8 | | | | | | | | | | | | | | | | | | | | |
| 327 | 810 | B1.0|REF99_V4|250 | 1007 | B1.0|REF99_V4|9526 | 26 | 39 | 24 | 10 | | | | | | | | | | | | | | | | | | | | |
| 328 | 131 | B1.0|REF99_V4|251 | 974 | B1.0|REF99_V4|2831 | 30 | 37 | 27 | 10 | | | | | | | | | | | | | | | | | | | | |
| 329 | 131 | B1.0|REF99_V4|251 | 615 | B1.0|REF99_V4|3374 | 30 | 32 | 24 | 9 | | | | | | | | | | | | | | | | | | | | |
| 330 | 131 | B1.0|REF99_V4|251 | 916 | B1.0|REF99_V4|3675 | 30 | 37 | 27 | 10 | | | | | | | | | | | | | | | | | | | | |
| 331 | 131 | B1.0|REF99_V4|251 | 1012 | B1.0|REF99_V4|597 | 30 | 34 | 24 | 10 | | | | | | | | | | | | | | | | | | | | |
| 332 | 131 | B1.0|REF99_V4|251 | 837 | B1.0|REF99_V4|720 | 30 | 47 | 28 | 13 | | | | | | | | | | | | | | | | | | | | |
| 333 | 131 | B1.0|REF99_V4|251 | 713 | B1.0|REF99_V4|754 | 30 | 37 | 28 | 10 | | | | | | | | | | | | | | | | | | | | |
| 334 | 131 | B1.0|REF99_V4|251 | 915 | B1.0|REF99_V4|4884 | 30 | 33 | 24 | 10 | | | | | | | | | | | | | | | | | | | | |
| 335 | 131 | B1.0|REF99_V4|251 | 1007 | B1.0|REF99_V4|9526 | 30 | 39 | 26 | 11 | | | | | | | | | | | | | | | | | | | | |
| 337 | 1086 | B1.0|REF99_V4|25794 | 1093 | B1.0|REF99_V4|429 | | | | | | | | | 21 | 20 | 14 | 6 | | | | | | | | | | | | |
| 338 | 943 | B1.0|REF99_V4|26030 | 974 | B1.0|REF99_V4|2831 | 30 | 37 | 30 | 10 | | | | | | | | | | | | | | | | | | | | |
| 339 | 943 | B1.0|REF99_V4|26030 | 615 | B1.0|REF99_V4|3374 | 30 | 32 | 27 | 9 | | | | | | | | | | | | | | | | | | | | |
| 340 | 943 | B1.0|REF99_V4|26030 | 963 | B1.0|REF99_V4|33855 | 30 | 36 | 26 | 10 | | | | | | | | | | | | | | | | | | | | |
| 341 | 943 | B1.0|REF99_V4|26030 | 916 | B1.0|REF99_V4|3675 | 30 | 37 | 30 | 10 | | | | | | | | | | | | | | | | | | | | |
| 342 | 943 | B1.0|REF99_V4|26030 | 69 | B1.0|REF99_V4|4506 | 30 | 31 | 24 | 9 | | | | | | | | | | | | | | | | | | | | |
| 343 | 943 | B1.0|REF99_V4|26030 | 1012 | B1.0|REF99_V4|597 | 30 | 34 | 27 | 10 | | | | | | | | | | | | | | | | | | | | |
| 344 | 943 | B1.0|REF99_V4|26030 | 837 | B1.0|REF99_V4|720 | 30 | 47 | 30 | 13 | | | | | | | | | | | | | | | | | | | | |
| 345 | 943 | B1.0|REF99_V4|26030 | 713 | B1.0|REF99_V4|754 | 30 | 37 | 28 | 10 | | | | | | | | | | | | | | | | | | | | |
| 346 | 943 | B1.0|REF99_V4|26030 | 915 | B1.0|REF99_V4|4884 | 30 | 33 | 27 | 9 | | | | | | | | | | | | | | | | | | | | |
| 347 | 943 | B1.0|REF99_V4|26030 | 1007 | B1.0|REF99_V4|9526 | 30 | 39 | 27 | 11 | | | | | | | | | | | | | | | | | | | | |
| 348 | 974 | B1.0|REF99_V4|2831 | 615 | B1.0|REF99_V4|3374 | 37 | 32 | 27 | 11 | | | | | | | | | | | | | | | | | | | | |
| 349 | 974 | B1.0|REF99_V4|2831 | 963 | B1.0|REF99_V4|33855 | 37 | 36 | 33 | 12 | | | | | | | | | | | | | | | | | | | | |
| 350 | 974 | B1.0|REF99_V4|2831 | 916 | B1.0|REF99_V4|3675 | 37 | 37 | 30 | 10 | | | | | | | | | | | | | | | | | | | | |
| 351 | 974 | B1.0|REF99_V4|2831 | 961 | B1.0|REF99_V4|3580 | 37 | 23 | 23 | 8 | | | | | | | | | | | | | | | | | | | | |
| 352 | 974 | B1.0|REF99_V4|2831 | 916 | B1.0|REF99_V4|3675 | 37 | 37 | 35 | 13 | | | | | | | | | | | | | | | | | | | | |
| 353 | 974 | B1.0|REF99_V4|2831 | 945 | B1.0|REF99_V4|4442 | 37 | 26 | 26 | 9 | | | | | | | | | | | | | | | | | | | | |
| 354 | 974 | B1.0|REF99_V4|2831 | 69 | B1.0|REF99_V4|4506 | 37 | 31 | 29 | 11 | | | | | | | | | | | | | | | | | | | | |
| 355 | 974 | B1.0|REF99_V4|2831 | 60 | B1.0|REF99_V4|4514 | 37 | 22 | 22 | 8 | | | | | | | | | | | | | | | | | | | | |
| 356 | 974 | B1.0|REF99_V4|2831 | 1012 | B1.0|REF99_V4|597 | 37 | 34 | 34 | 12 | | | | | | | | | | | | | | | | | | | | |
| 357 | 974 | B1.0|REF99_V4|2831 | 319 | B1.0|REF99_V4|70731 | 37 | 25 | 25 | 9 | | | | | | | | | | | | | | | | | | | | |
| 358 | 974 | B1.0|REF99_V4|2831 | 837 | B1.0|REF99_V4|720 | 37 | 47 | 37 | 16 | | | | | | | | | | | | | | | | | | | | |
| 359 | 974 | B1.0|REF99_V4|2831 | 713 | B1.0|REF99_V4|754 | 37 | 37 | 35 | 13 | | | | | | | | | | | | | | | | | | | | |
| 360 | 974 | B1.0|REF99_V4|2831 | 915 | B1.0|REF99_V4|4884 | 37 | 33 | 33 | 11 | | | | | | | | | | | | | | | | | | | | |
| 361 | 974 | B1.0|REF99_V4|2831 | 1007 | B1.0|REF99_V4|9526 | 37 | 39 | 34 | 14 | | | | | | | | | | | | | | | | | | | | |
| 362 | 615 | B1.0|REF99_V4|3374 | 963 | B1.0|REF99_V4|33855 | 32 | 36 | 28 | 11 | | | | | | | | | | | | | | | | | | | | |
| 363 | 615 | B1.0|REF99_V4|3374 | 916 | B1.0|REF99_V4|3675 | 32 | 37 | 32 | 11 | | | | | | | | | | | | | | | | | | | | |
| 364 | 615 | B1.0|REF99_V4|3374 | 69 | B1.0|REF99_V4|4506 | 32 | 31 | 25 | 9 | | | | | | | | | | | | | | | | | | | | |
| 365 | 615 | B1.0|REF99_V4|3374 | 1012 | B1.0|REF99_V4|597 | 32 | 34 | 29 | 10 | | | | | | | | | | | | | | | | | | | | |
| 366 | 615 | B1.0|REF99_V4|3374 | 837 | B1.0|REF99_V4|720 | 32 | 47 | 32 | 14 | | | | | | | | | | | | | | | | | | | | |
| 367 | 615 | B1.0|REF99_V4|3374 | 713 | B1.0|REF99_V4|754 | 32 | 37 | 30 | 11 | | | | | | | | | | | | | | | | | | | | |

TABLE 14-continued

| A PAIR | B Endophyte 1 (SEQ ID) | C Endophyte 1 (OTU) | D Endophyte 2 (SEQ ID) | E Endophyte 2 (OTU) | F Bacteria - dicots | | | | G Bacteria - dicots, roots | | | | H Bacteria - dicots, seeds | | | | I Fungi - dicots | | | | J Fungi - dicots, roots | | | | K Fungi - dicots, seeds | | | |
|---|---|---|---|---|---|---|---|---|---|---|---|---|---|---|---|---|---|---|---|---|---|---|---|---|---|---|---|---|
| | | | | | N1 | N2 | OC | EC | N1 | N2 | OC | EC | N1 | N2 | OC | EC | N1 | N2 | OC | EC | N1 | N2 | OC | EC | N1 | N2 | OC | EC |
| 372 | 615 | B1.0iREF99_V4l3374 | 915 | B1.0iREF99_V4l884 | 32 | 33 | 28 | 10 | | | | | | | | | | | | | | | | | | | | |
| 373 | 615 | B1.0iREF99_V4l3374 | 1007 | B1.0iREF99_V4l9526 | 32 | 39 | 29 | 12 | | | | | | | | | | | | | | | | | | | | |
| 374 | 963 | B1.0iREF99_V4l33855 | 916 | B1.0iREF99_V4l3675 | 36 | 37 | 33 | 12 | | | | | | | | | | | | | | | | | | | | |
| 375 | 963 | B1.0iREF99_V4l33855 | 1012 | B1.0iREF99_V4l4597 | 36 | 34 | 30 | 11 | | | | | | | | | | | | | | | | | | | | |
| 376 | 963 | B1.0iREF99_V4l33855 | 713 | B1.0iREF99_V4l4754 | 36 | 37 | 32 | 12 | | | | | | | | | | | | | | | | | | | | |
| 377 | 963 | B1.0iREF99_V4l33855 | 1007 | B1.0iREF99_V4l9526 | 36 | 39 | 33 | 13 | | | | | | | | | | | | | | | | | | | | |
| 378 | 916 | B1.0iREF99_V4l3675 | 945 | B1.0iREF99_V4l4442 | 37 | 26 | 26 | 9 | | | | | | | | | | | | | | | | | | | | |
| 380 | 916 | B1.0iREF99_V4l3675 | 69 | B1.0iREF99_V4l4506 | 37 | 31 | 29 | 11 | | | | | | | | | | | | | | | | | | | | |
| 381 | 916 | B1.0iREF99_V4l3675 | 1012 | B1.0iREF99_V4l4597 | 37 | 34 | 34 | 12 | | | | | | | | | | | | | | | | | | | | |
| 382 | 916 | B1.0iREF99_V4l3675 | 319 | B1.0iREF99_V4l70731 | 37 | 25 | 25 | 9 | | | | | | | | | | | | | | | | | | | | |
| 383 | 916 | B1.0iREF99_V4l3675 | 837 | B1.0iREF99_V4l4720 | 37 | 47 | 35 | 16 | | | | | | | | | | | | | | | | | | | | |
| 384 | 916 | B1.0iREF99_V4l3675 | 713 | B1.0iREF99_V4l4754 | 37 | 37 | 35 | 13 | | | | | | | | | | | | | | | | | | | | |
| 385 | 916 | B1.0iREF99_V4l3675 | 915 | B1.0iREF99_V4l4884 | 37 | 33 | 33 | 11 | | | | | | | | | | | | | | | | | | | | |
| 386 | 916 | B1.0iREF99_V4l3675 | 1007 | B1.0iREF99_V4l9526 | 37 | 39 | 34 | 14 | | | | | | | | | | | | | | | | | | | | |
| 388 | 945 | B1.0iREF99_V4l4442 | 1012 | B1.0iREF99_V4l4597 | 26 | 34 | 24 | 8 | | | | | | | | | | | | | | | | | | | | |
| 393 | 69 | B1.0iREF99_V4l4506 | 1012 | B1.0iREF99_V4l4597 | 31 | 34 | 28 | 10 | | | | | | | | | | | | | | | | | | | | |
| 394 | 69 | B1.0iREF99_V4l4506 | 837 | B1.0iREF99_V4l4720 | 31 | 47 | 30 | 14 | | | | | | | | | | | | | | | | | | | | |
| 395 | 69 | B1.0iREF99_V4l4506 | 713 | B1.0iREF99_V4l4754 | 31 | 37 | 28 | 11 | | | | | | | | | | | | | | | | | | | | |
| 396 | 69 | B1.0iREF99_V4l4506 | 915 | B1.0iREF99_V4l4884 | 31 | 33 | 27 | 10 | | | | | | | | | | | | | | | | | | | | |
| 397 | 69 | B1.0iREF99_V4l4506 | 1007 | B1.0iREF99_V4l9526 | 31 | 39 | 29 | 11 | | | | | | | | | | | | | | | | | | | | |
| 398 | 818 | B1.0iREF99_V4l531 | 837 | B1.0iREF99_V4l4720 | 30 | 47 | 24 | 13 | | | | | | | | | | | | | | | | | | | | |
| 399 | 702 | B1.0iREF99_V4l5579 | 1134 | B1.0iREF99_V4l4986 | 32 | 41 | 27 | 12 | | | 32 | 31 | 27 | 14 | | | | | | | | | | | | | | |
| 400 | 1012 | B1.0iREF99_V4l4597 | 837 | B1.0iREF99_V4l4720 | 34 | 47 | 34 | 15 | | | | | | | | | | | | | | | | | | | | |
| 401 | 1012 | B1.0iREF99_V4l4597 | 713 | B1.0iREF99_V4l4754 | 34 | 37 | 32 | 12 | | | | | | | | | | | | | | | | | | | | |
| 402 | 1012 | B1.0iREF99_V4l4597 | 915 | B1.0iREF99_V4l4884 | 34 | 33 | 30 | 11 | | | | | | | | | | | | | | | | | | | | |
| 403 | 1012 | B1.0iREF99_V4l4597 | 1007 | B1.0iREF99_V4l9526 | 34 | 39 | 31 | 12 | | | | | | | | | | | | | | | | | | | | |
| 404 | 319 | B1.0iREF99_V4l70731 | 1007 | B1.0iREF99_V4l9526 | 25 | 39 | 23 | 9 | | | | | | | | | | | | | | | | | | | | |
| 405 | 837 | B1.0iREF99_V4l4720 | 713 | B1.0iREF99_V4l4754 | 47 | 37 | 35 | 16 | | | | | | | | | | | | | | | | | | | | |
| 406 | 837 | B1.0iREF99_V4l4720 | 915 | B1.0iREF99_V4l4884 | 47 | 33 | 33 | 15 | | | | | | | | | | | | | | | | | | | | |
| 407 | 837 | B1.0iREF99_V4l4720 | 1007 | B1.0iREF99_V4l9526 | 47 | 39 | 36 | 17 | | | | | | | | | | | | | | | | | | | | |
| 408 | 713 | B1.0iREF99_V4l4754 | 915 | B1.0iREF99_V4l4884 | 37 | 33 | 32 | 11 | | | | | | | | | | | | | | | | | | | | |
| 409 | 713 | B1.0iREF99_V4l4754 | 1007 | B1.0iREF99_V4l9526 | 37 | 39 | 32 | 14 | | | | | | | | | | | | | | | | | | | | |
| 410 | 915 | B1.0iREF99_V4l4884 | 1007 | B1.0iREF99_V4l9526 | 33 | 39 | 32 | 12 | | | | | | | | | | | | | | | | | | | | |
| 413 | 1108 | B1.0iREF97_V4l1 | 1113 | B1.0iREF99_V4l52497 | | | | | | | | | | | | | | | | | | | | | | | | |
| 421 | 1089 | B1.0iREF97_V4l127 | 1112 | B1.0iREF99_V4l14460 | 31 | 30 | 20 | 9 | | | | | | | | | | | | | | | | | | | | |
| 422 | 1089 | B1.0iREF97_V4l127 | 1175 | B1.0iREF99_V4l4284 | | | | | | | | | | | | | | | | | | | | | | | | |
| 424 | 1089 | B1.0iREF97_V4l127 | 702 | B1.0iREF99_V4l5579 | | | | | | | | | | | | | | | | | | | | | | | | |
| 429 | 1098 | B1.0iREF97_V4l171 | 1104 | B1.0iREF99_V4l122519 | 22 | 16 | 14 | 3 | | | | | | | | | | | | | | | | | | | | |
| 430 | 1098 | B1.0iREF97_V4l171 | 1112 | B1.0iREF99_V4l14460 | | | | | | | | | | | | | | | | | | | | | | | | |
| 432 | 1098 | B1.0iREF97_V4l171 | 1105 | B1.0iREF99_V4l44080 | | | | | | | | | | | | | | | | | | | | | | | | |
| 437 | 519 | B1.0iREF97_V4l35285 | 1191 | B1.0iREF99_V4l150716 | 16 | 27 | 15 | 4 | | | 16 | 12 | 11 | 3 | | | | | | | | | | | | | | |
| 439 | 519 | B1.0iREF97_V4l35285 | 519 | B1.0iREF99_V4l35285 | 16 | 22 | 16 | 3 | | | 24 | 30 | 20 | 10 | | | | | | | | | | | | | | |
| 445 | 527 | B1.0iREF97_V4l66392 | 527 | B1.0iREF99_V4l66392 | | | | | | | 24 | 22 | 15 | 8 | | | | | | | | | | | | | | | |
| 447 | 533 | B1.0iREF97_V4l69685 | 533 | B1.0iREF99_V4l69685 | | | | | | | 24 | 32 | 18 | 11 | | | | | | | | | | | | | | | |
| 451 | 510 | B1.0iREF97_V4l8981 | 1105 | B1.0iREF99_V4l44080 | | | | | | | 14 | 16 | 14 | 3 | | | | | | | | | | | | | | | |
| 454 | 492 | B1.0iREF97_V4l9806 | 533 | B1.0iREF99_V4l69685 | | | | | | | 14 | 30 | 13 | 6 | | | | | | | | | | | | | | | |
| | | | | | | | | | | | 14 | 17 | 11 | 3 | | | | | | | | | | | | | | |
| | | | | | | | | | | | 16 | 27 | 15 | 6 | | | | | | | | | | | | | | |
| | | | | | | | | | | | 16 | 22 | 16 | 5 | | | | | | | | | | | | | | |
| | | | | | | | | | | | 9 | 13 | 9 | 2 | | | | | | | | | | | | | | |
| | | | | | | | | | | | 11 | 22 | 11 | 4 | | | | | | | | | | | | | | |
| | | | | | | | | | | | 14 | 17 | 11 | 3 | | | | | | | | | | | | | | |
| | | | | | | | | | | | 13 | 22 | 12 | 4 | | | | | | | | | | | | | | |

TABLE 14-continued

| PAIR | SEQ ID Endophyte 1 | Endophyte 1 (OTU) | SEQ ID Endophyte 2 | Endophyte 2 (OTU) | F Bacteria - dicots N1 | N2 | OC | EC | G Bacteria - dicots, roots N1 | N2 | OC | EC | H Bacteria - dicots, seeds N1 | N2 | OC | EC | I Fungi - dicots N1 | N2 | OC | EC | J Fungi - dicots, roots N1 | N2 | OC | EC | K Fungi - dicots, seeds N1 | N2 | OC | EC |
|---|---|---|---|---|---|---|---|---|---|---|---|---|---|---|---|---|---|---|---|---|---|---|---|---|---|---|---|---|
| 461 | 1110 | B1.0\|REF99_V4\|108549 | 1099 | B1.0\|REF99_V4\|11708 | | | | | | | | | 18 | 15 | 12 | 4 | | | | | | | | | | | | |
| 464 | 1110 | B1.0\|REF99_V4\|108549 | 1113 | B1.0\|REF99_V4\|52497 | | | | | | | | | 18 | 12 | 11 | 3 | | | | | | | | | | | | |
| 467 | 499 | B1.0\|REF99_V4\|1098 | 519 | B1.0\|REF99_V4\|35285 | | | | | | | | | 17 | 22 | 13 | 5 | | | | | | | | | | | | |
| 471 | 1099 | B1.0\|REF99_V4\|11708 | 1113 | B1.0\|REF99_V4\|52497 | | | | | | | | | 15 | 12 | 10 | 3 | | | | | | | | | | | | |
| 472 | 1099 | B1.0\|REF99_V4\|11708 | 1163 | B1.0\|REF99_V4\|46806 | | | | | | | | | 15 | 31 | 14 | 7 | | | | | | | | | | | | |
| 473 | 982 | B1.0\|REF99_V4\|118 | 972 | B1.0\|REF99_V4\|218 | 54 | 34 | 28 | 17 | | | | | | | | | | | | | | | | | | | | |
| 475 | 982 | B1.0\|REF99_V4\|118 | 957 | B1.0\|REF99_V4\|921 | 54 | 30 | 26 | 15 | | | | | | | | | | | | | | | | | | | | |
| 477 | 535 | B1.0\|REF99_V4\|11976 | 496 | B1.0\|REF99_V4\|470 | 16 | 32 | 16 | 5 | | | | | | | | | | | | | | | | | | | | |
| 478 | 1104 | B1.0\|REF99_V4\|122519 | 1112 | B1.0\|REF99_V4\|14460 | | | | | | | | | 16 | 31 | 16 | 7 | | | | | | | | | | | | |
| 479 | 1104 | B1.0\|REF99_V4\|122519 | 1098 | B1.0\|REF99_V4\|4171 | | | | | | | | | 16 | 30 | 14 | 7 | | | | | | | | | | | | |
| 480 | 1104 | B1.0\|REF99_V4\|122519 | 1105 | B1.0\|REF99_V4\|44080 | | | | | | | | | 16 | 39 | 16 | 9 | | | | | | | | | | | | |
| 483 | 1158 | B1.0\|REF99_V4\|1323 | 1191 | B1.0\|REF99_V4\|150716 | | | | | | | | | 16 | 17 | 13 | 4 | | | | | | | | | | | | |
| 485 | 1112 | B1.0\|REF99_V4\|14460 | 1191 | B1.0\|REF99_V4\|150716 | 30 | 27 | 19 | 8 | | | | | 30 | 27 | 19 | 12 | | | | | | | | | | | | |
| 493 | 1191 | B1.0\|REF99_V4\|150716 | 519 | B1.0\|REF99_V4\|35285 | 27 | 22 | 18 | 6 | | | | | 27 | 22 | 18 | 9 | | | | | | | | | | | | |
| 495 | 1191 | B1.0\|REF99_V4\|150716 | 527 | B1.0\|REF99_V4\|66392 | | | | | | | | | | | | | | | | | | | | | | | | |
| 505 | 519 | B1.0\|REF99_V4\|35285 | 1163 | B1.0\|REF99_V4\|46806 | 22 | 31 | 18 | 6 | | | | | 22 | 31 | 18 | 10 | | | | | | | | | | | | |
| 508 | 1105 | B1.0\|REF99_V4\|44080 | 510 | B1.0\|REF99_V4\|48981 | | | | | | | | | 17 | 20 | 13 | 5 | | | | | | | | | | | | |
| 511 | 1201 | B1.0\|REF99_V4\|42 | 1163 | B1.0\|REF99_V4\|46806 | | | | | | | | | 30 | 31 | 21 | 13 | | | | | | | | | | | | |
| 533 | 1098 | B1.0\|REF99_V4\|4171 | 1092 | B1.0\|REF99_V4\|476 | 21 | 37 | 21 | 7 | | | | | 14 | 14 | 10 | 3 | | | | | | | | | | | | |
| 535 | 313 | B1.0\|REF97_V4\|18024 | 974 | B1.0\|REF99_V4\|2831 | 21 | 34 | 21 | 7 | | | | | | | | | | | | | | | | | | | | |
| 536 | 313 | B1.0\|REF97_V4\|18024 | 71 | B1.0\|REF99_V4\|1351 | 21 | 26 | 16 | 5 | | | | | | | | | | | | | | | | | | | | |
| 537 | 313 | B1.0\|REF97_V4\|18024 | 810 | B1.0\|REF99_V4\|4250 | 21 | 37 | 21 | 7 | | | | | | | | | | | | | | | | | | | | |
| 538 | 313 | B1.0\|REF97_V4\|18024 | 974 | B1.0\|REF99_V4\|2831 | 21 | 37 | 23 | 7 | | | | | | | | | | | | | | | | | | | | |
| 540 | 974 | B1.0\|REF97_V4\|2831 | 916 | B1.0\|REF99_V4\|3675 | 37 | 23 | 23 | 8 | | | | | | | | | | | | | | | | | | | | |
| 541 | 974 | B1.0\|REF97_V4\|2831 | 962 | B1.0\|REF99_V4\|102519 | 37 | 25 | 24 | 9 | | | | | | | | | | | | | | | | | | | | |
| 543 | 974 | B1.0\|REF97_V4\|2831 | 892 | B1.0\|REF99_V4\|1177 | 37 | 20 | 19 | 7 | | | | | | | | | | | | | | | | | | | | |
| 544 | 974 | B1.0\|REF97_V4\|2831 | 839 | B1.0\|REF99_V4\|1186 | 37 | 31 | 27 | 11 | | | | | | | | | | | | | | | | | | | | |
| 545 | 974 | B1.0\|REF97_V4\|2831 | 939 | B1.0\|REF99_V4\|1317 | 37 | 32 | 22 | 8 | | | | | | | | | | | | | | | | | | | | |
| 547 | 974 | B1.0\|REF97_V4\|2831 | 1013 | B1.0\|REF99_V4\|13951 | 37 | 20 | 20 | 7 | | | | | | | | | | | | | | | | | | | | |
| 549 | 974 | B1.0\|REF97_V4\|2831 | 59 | B1.0\|REF99_V4\|171149 | 37 | 21 | 21 | 8 | | | | | | | | | | | | | | | | | | | | |
| 550 | 974 | B1.0\|REF97_V4\|2831 | 313 | B1.0\|REF99_V4\|18024 | 37 | 21 | 23 | 8 | | | | | | | | | | | | | | | | | | | | |
| 551 | 974 | B1.0\|REF97_V4\|2831 | 613 | B1.0\|REF99_V4\|42200 | 37 | 23 | 19 | 7 | | | | | | | | | | | | | | | | | | | | |
| 552 | 974 | B1.0\|REF97_V4\|2831 | 887 | B1.0\|REF99_V4\|42238 | 37 | 41 | 27 | 14 | | | | | | | | | | | | | | | | | | | | |
| 556 | 974 | B1.0\|REF97_V4\|2831 | 681 | B1.0\|REF99_V4\|4234 | 37 | 31 | 24 | 11 | | | | | | | | | | | | | | | | | | | | |
| 559 | 974 | B1.0\|REF97_V4\|2831 | 734 | B1.0\|REF99_V4\|1558 | 33 | 25 | 21 | 8 | | | | | | | | | | | | | | | | | | | | |
| 561 | 916 | B1.0\|REF97_V4\|3675 | 892 | B1.0\|REF99_V4\|1177 | 33 | 21 | 24 | 10 | | | | | | | | | | | | | | | | | | | | |
| 562 | 916 | B1.0\|REF97_V4\|3675 | 939 | B1.0\|REF99_V4\|1317 | 33 | 22 | 20 | 7 | | | | | | | | | | | | | | | | | | | | |
| 564 | 916 | B1.0\|REF97_V4\|3675 | 1013 | B1.0\|REF99_V4\|13951 | 33 | 20 | 18 | 6 | | | | | | | | | | | | | | | | | | | | |
| 566 | 916 | B1.0\|REF97_V4\|3675 | 59 | B1.0\|REF99_V4\|171149 | 33 | 41 | 25 | 13 | | | | | | | | | | | | | | | | | | | | |
| 568 | 916 | B1.0\|REF97_V4\|3675 | 681 | B1.0\|REF99_V4\|4234 | 33 | 23 | 21 | 7 | | | | | | | | | | | | | | | | | | | | |
| 569 | 916 | B1.0\|REF97_V4\|3675 | 961 | B1.0\|REF99_V4\|43580 | 33 | 31 | 23 | 10 | | | | | | | | | | | | | | | | | | | | |
| 582 | 1106 | B1.0\|REF97_V4\|466 | 734 | B1.0\|REF99_V4\|1558 | 37 | 31 | 23 | 11 | | | | | | | | | | | | | | | | | | | | |
| 585 | 1106 | B1.0\|REF97_V4\|466 | 837 | B1.0\|REF99_V4\|4720 | 37 | 47 | 31 | 16 | | | | | | | | | | | | | | | | | | | | |
| 587 | 837 | B1.0\|REF97_V4\|4720 | 892 | B1.0\|REF99_V4\|1177 | 31 | 25 | 19 | 7 | | | | | | | | | | | | | | | | | | | | |
| 591 | 837 | B1.0\|REF97_V4\|4720 | 939 | B1.0\|REF99_V4\|1317 | 31 | 31 | 22 | 9 | | | | | | | | | | | | | | | | | | | | |

TABLE 14-continued

| A PAIR | B Endophyte 1 (SEQ ID) | C Endophyte 1 (OTU) | D Endophyte 2 (SEQ ID) | E Endophyte 2 (OTU) | F Bacteria - dicots | | | | G Bacteria - dicots, roots | | | | H Bacteria - dicots, seeds | | | | I Fungi - dicots | | | | J Fungi - dicots, roots | | | | K Fungi - dicots, seeds | | | |
|---|---|---|---|---|---|---|---|---|---|---|---|---|---|---|---|---|---|---|---|---|---|---|---|---|---|---|---|---|
| | | | | | N1 | N2 | OC | EC | N1 | N2 | OC | EC | N1 | N2 | OC | EC | N1 | N2 | OC | EC | N1 | N2 | OC | EC | N1 | N2 | OC | EC |
| 592 | 837 | B1.0iREF97_V4I720 | 648 | B1.0iREF99_V4I414 | 31 | 54 | 30 | 16 | | | | | | | | | | | | | | | | |
| 595 | 837 | B1.0iREF97_V4I720 | 313 | B1.0iREF99_V4I18024 | 31 | 21 | 18 | 6 | | | | | | | | | | | | | | | | |
| 597 | 837 | B1.0iREF97_V4I720 | 131 | B1.0iREF99_V4I251 | 31 | 30 | 20 | 9 | | | | | | | | | | | | | | | | |
| 601 | 837 | B1.0iREF97_V4I720 | 945 | B1.0iREF99_V4I442 | 31 | 26 | 20 | 8 | | | | | | | | | | | | | | | | |
| 602 | 837 | B1.0iREF97_V4I720 | 60 | B1.0iREF99_V4I514 | 31 | 22 | 18 | 6 | | | | | | | | | | | | | | | | |
| 606 | 837 | B1.0iREF97_V4I720 | 319 | B1.0iREF99_V4I70731 | 31 | 25 | 21 | 7 | | | | | | | | | | | | | | | | |
| 608 | 1007 | B1.0iREF97_V4I9526 | 892 | B1.0iREF99_V4I1177 | 31 | 25 | 20 | 7 | | | | | | | | | | | | | | | | |
| 609 | 1007 | B1.0iREF97_V4I9526 | 116 | B1.0iREF99_V4I1567 | 31 | 23 | 21 | 8 | | | | | | | | | | | | | | | | |
| 610 | 1007 | B1.0iREF97_V4I9526 | 810 | B1.0iREF99_V4I250 | 31 | 26 | 19 | 8 | | | | | | | | | | | | | | | | |
| 611 | 1007 | B1.0iREF97_V4I9526 | 131 | B1.0iREF99_V4I251 | 31 | 30 | 21 | 9 | | | | | | | | | | | | | | | | |
| 612 | 1007 | B1.0iREF97_V4I9526 | 963 | B1.0iREF99_V4I33855 | 31 | 36 | 26 | 10 | | | | | | | | | | | | | | | | |
| 613 | 1007 | B1.0iREF97_V4I9526 | 945 | B1.0iREF99_V4I442 | 31 | 26 | 22 | 8 | | | | | | | | | | | | | | | | |
| 615 | 1007 | B1.0iREF97_V4I9526 | 713 | B1.0iREF99_V4I754 | 31 | 37 | 28 | 11 | | | | | | | | | | | | | | | | |
| 616 | 962 | B1.0iREF99_V4I102519 | 71 | B1.0iREF99_V4I1351 | 23 | 34 | 22 | 7 | | | | | | | | | | | | | | | | |
| 617 | 962 | B1.0iREF99_V4I102519 | 974 | B1.0iREF99_V4I2831 | 23 | 37 | 23 | 8 | | | | | | | | | | | | | | | | |
| 618 | 962 | B1.0iREF99_V4I102519 | 916 | B1.0iREF99_V4I3675 | 23 | 37 | 23 | 8 | | | | | | | | | | | | | | | | |
| 619 | 962 | B1.0iREF99_V4I102519 | 886 | B1.0iREF99_V4I1287 | 48 | 22 | 22 | 10 | | | | | | | | | | | | | | | | |
| 620 | 137 | B1.0iREF99_V4I11 | 648 | B1.0iREF99_V4I414 | 48 | 54 | 40 | 24 | | | | | | | | | | | | | | | | |
| 623 | 137 | B1.0iREF99_V4I11 | 613 | B1.0iREF99_V4I2200 | 48 | 23 | 23 | 10 | | | | | | | | | | | | | | | | |
| 624 | 137 | B1.0iREF99_V4I11 | 131 | B1.0iREF99_V4I251 | 48 | 30 | 28 | 14 | | | | | | | | | | | | | | | | |
| 626 | 137 | B1.0iREF99_V4I11 | 945 | B1.0iREF99_V4I442 | 48 | 26 | 26 | 12 | | | | | | | | | | | | | | | | |
| 627 | 137 | B1.0iREF99_V4I11 | 60 | B1.0iREF99_V4I514 | 48 | 22 | 21 | 10 | | | | | | | | | | | | | | | | |
| 628 | 137 | B1.0iREF99_V4I11 | 734 | B1.0iREF99_V4I558 | 48 | 31 | 27 | 14 | | | | | | | | | | | | | | | | |
| 629 | 137 | B1.0iREF99_V4I11 | 319 | B1.0iREF99_V4I70731 | 48 | 25 | 25 | 11 | | | | | | | | | | | | | | | | |
| 637 | 884 | B1.0iREF99_V4I1164 | 892 | B1.0iREF99_V4I1177 | 31 | 25 | 22 | 9 | | | | | | | | | | | | | | | | |
| 638 | 884 | B1.0iREF99_V4I1164 | 886 | B1.0iREF99_V4I1287 | 31 | 22 | 18 | 9 | | | | | | | | | | | | | | | | |
| 639 | 884 | B1.0iREF99_V4I1164 | 939 | B1.0iREF99_V4I1317 | 31 | 31 | 25 | 9 | | | | | | | | | | | | | | | | |
| 640 | 884 | B1.0iREF99_V4I1164 | 116 | B1.0iREF99_V4I1567 | 31 | 29 | 22 | 7 | | | | | | | | | | | | | | | | |
| 641 | 884 | B1.0iREF99_V4I1164 | 683 | B1.0iREF99_V4I2385 | 31 | 20 | 19 | 9 | | | | | | | | | | | | | | | | |
| 642 | 884 | B1.0iREF99_V4I1164 | 131 | B1.0iREF99_V4I251 | 31 | 30 | 27 | 10 | | | | | | | | | | | | | | | | |
| 643 | 884 | B1.0iREF99_V4I1164 | 963 | B1.0iREF99_V4I33855 | 31 | 36 | 23 | 9 | | | | | | | | | | | | | | | | |
| 644 | 884 | B1.0iREF99_V4I1164 | 945 | B1.0iREF99_V4I442 | 31 | 26 | 23 | 8 | | | | | | | | | | | | | | | | |
| 647 | 884 | B1.0iREF99_V4I1164 | 319 | B1.0iREF99_V4I70731 | 31 | 25 | 22 | 7 | | | | | | | | | | | | | | | | |
| 648 | 884 | B1.0iREF99_V4I1164 | 713 | B1.0iREF99_V4I754 | 31 | 37 | 29 | 11 | | | | | | | | | | | | | | | | |
| 649 | 892 | B1.0iREF99_V4I1177 | 959 | B1.0iREF99_V4I126 | 25 | 32 | 21 | 8 | | | | | | | | | | | | | | | | |
| 650 | 892 | B1.0iREF99_V4I1177 | 1011 | B1.0iREF99_V4I2104 | 25 | 32 | 23 | 8 | | | | | | | | | | | | | | | | |
| 651 | 892 | B1.0iREF99_V4I1177 | 789 | B1.0iREF99_V4I2172 | 25 | 38 | 23 | 9 | | | | | | | | | | | | | | | | |
| 652 | 892 | B1.0iREF99_V4I1177 | 943 | B1.0iREF99_V4I26030 | 25 | 30 | 21 | 7 | | | | | | | | | | | | | | | | |
| 653 | 892 | B1.0iREF99_V4I1177 | 974 | B1.0iREF99_V4I2831 | 25 | 37 | 24 | 9 | | | | | | | | | | | | | | | | |
| 654 | 892 | B1.0iREF99_V4I1177 | 916 | B1.0iREF99_V4I3675 | 25 | 39 | 21 | 9 | | | | | | | | | | | | | | | | |
| 667 | 892 | B1.0iREF99_V4I1177 | 1007 | B1.0iREF99_V4I9526 | 25 | 24 | 16 | 5 | 19 | 24 | 16 | 12 | | | | | | | | | | | | |
| 668 | 839 | B1.0iREF99_V4I1186 | 1221 | B1.0iREF99_V4I2512 | 20 | 37 | 19 | 7 | | | | | | | | | | | | | | | | |
| 669 | 839 | B1.0iREF99_V4I1186 | 974 | B1.0iREF99_V4I2831 | 20 | 34 | 18 | 6 | | | | | | | | | | | | | | | | |
| 670 | 839 | B1.0iREF99_V4I1186 | 1012 | B1.0iREF99_V4I597 | 20 | 47 | 20 | 9 | | | | | | | | | | | | | | | | |
| 678 | 959 | B1.0iREF99_V4I126 | 886 | B1.0iREF99_V4I1287 | 32 | 22 | 19 | 7 | | | | | | | | | | | | | | | | |

TABLE 14-continued

| A PAIR | B Endophyte 1 (SEQ ID) | C Endophyte 1 (OTU) | D Endophyte 2 (SEQ ID) | E Endophyte 2 (OTU) | F Bacteria - dicots | | | | G Bacteria - dicots, roots | | | | H Bacteria - dicots, seeds | | | | I Fungi - dicots | | | | J Fungi - dicots, roots | | | | K Fungi - dicots, seeds | | | |
|---|---|---|---|---|---|---|---|---|---|---|---|---|---|---|---|---|---|---|---|---|---|---|---|---|---|---|---|---|
| | | | | | N1 | N2 | OC | EC | N1 | N2 | OC | EC | N1 | N2 | OC | EC | N1 | N2 | OC | EC | N1 | N2 | OC | EC | N1 | N2 | OC | EC |
| 679 | 959 | B1.0|REF99_V4|1126 | 939 | B1.0|REF99_V4|1317 | 32 | 31 | 23 | 9 | | | | | | | | | | | | | | | | | | | | |
| 680 | 959 | B1.0|REF99_V4|1126 | 1013 | B1.0|REF99_V4|13951 | 32 | 22 | 20 | 7 | | | | | | | | | | | | | | | | | | | | |
| 682 | 959 | B1.0|REF99_V4|1126 | 59 | B1.0|REF99_V4|171149 | 32 | 20 | 18 | 6 | | | | | | | | | | | | | | | | | | | | |
| 684 | 959 | B1.0|REF99_V4|1126 | 313 | B1.0|REF99_V4|18024 | 32 | 21 | 18 | 6 | | | | | | | | | | | | | | | | | | | | |
| 685 | 959 | B1.0|REF99_V4|1126 | 613 | B1.0|REF99_V4|2200 | 32 | 23 | 20 | 7 | | | | | | | | | | | | | | | | | | | | |
| 686 | 959 | B1.0|REF99_V4|1126 | 681 | B1.0|REF99_V4|234 | 32 | 41 | 26 | 12 | | | | | | | | | | | | | | | | | | | | |
| 687 | 959 | B1.0|REF99_V4|1126 | 683 | B1.0|REF99_V4|2385 | 32 | 20 | 19 | 6 | | | | | | | | | | | | | | | | | | | | |
| 690 | 959 | B1.0|REF99_V4|1126 | 60 | B1.0|REF99_V4|514 | 32 | 22 | 21 | 7 | | | | | | | | | | | | | | | | | | | | |
| 692 | 959 | B1.0|REF99_V4|1126 | 734 | B1.0|REF99_V4|558 | 32 | 31 | 22 | 9 | | | | | | | | | | | | | | | | | | | | |
| 693 | 959 | B1.0|REF99_V4|1126 | 319 | B1.0|REF99_V4|70731 | 32 | 25 | 22 | 8 | | | | | | | | | | | | | | | | | | | | |
| 694 | 886 | B1.0|REF99_V4|1287 | 71 | B1.0|REF99_V4|1351 | 22 | 34 | 20 | 7 | | | | | | | | | | | | | | | | | | | | |
| 695 | 886 | B1.0|REF99_V4|1287 | 1011 | B1.0|REF99_V4|2104 | 22 | 32 | 19 | 7 | | | | | | | | | | | | | | | | | | | | |
| 696 | 886 | B1.0|REF99_V4|1287 | 789 | B1.0|REF99_V4|2172 | 22 | 38 | 21 | 8 | | | | | | | | | | | | | | | | | | | | |
| 698 | 886 | B1.0|REF99_V4|1287 | 943 | B1.0|REF99_V4|26030 | 22 | 30 | 18 | 6 | | | | | | | | | | | | | | | | | | | | |
| 699 | 886 | B1.0|REF99_V4|1287 | 615 | B1.0|REF99_V4|3374 | 22 | 32 | 18 | 7 | | | | | | | | | | | | | | | | | | | | |
| 700 | 886 | B1.0|REF99_V4|1287 | 945 | B1.0|REF99_V4|442 | 22 | 26 | 16 | 5 | | | | | | | | | | | | | | | | | | | | |
| 702 | 886 | B1.0|REF99_V4|1287 | 1012 | B1.0|REF99_V4|597 | 22 | 34 | 18 | 7 | | | | | | | | | | | | | | | | | | | | |
| 703 | 886 | B1.0|REF99_V4|1287 | 319 | B1.0|REF99_V4|70731 | 22 | 25 | 17 | 5 | | | | | | | | | | | | | | | | | | | | |
| 704 | 886 | B1.0|REF99_V4|1287 | 837 | B1.0|REF99_V4|720 | 22 | 47 | 21 | 10 | | | | | | | | | | | | | | | | | | | | |
| 705 | 886 | B1.0|REF99_V4|1287 | 713 | B1.0|REF99_V4|754 | 22 | 37 | 21 | 8 | | | | | | | | | | | | | | | | | | | | |
| 706 | 886 | B1.0|REF99_V4|1287 | 1007 | B1.0|REF99_V4|9526 | 22 | 39 | 19 | 8 | | | | | | | | | | | | | | | | | | | | |
| 707 | 939 | B1.0|REF99_V4|1317 | 71 | B1.0|REF99_V4|1351 | 31 | 34 | 26 | 10 | | | | | | | | | | | | | | | | | | | | |
| 708 | 939 | B1.0|REF99_V4|1317 | 789 | B1.0|REF99_V4|2172 | 31 | 38 | 27 | 11 | | | | | | | | | | | | | | | | | | | | |
| 709 | 939 | B1.0|REF99_V4|1317 | 683 | B1.0|REF99_V4|2385 | 31 | 20 | 18 | 6 | | | | | | | | | | | | | | | | | | | | |
| 710 | 939 | B1.0|REF99_V4|1317 | 810 | B1.0|REF99_V4|250 | 31 | 26 | 19 | 8 | | | | | | | | | | | | | | | | | | | | |
| 711 | 939 | B1.0|REF99_V4|1317 | 974 | B1.0|REF99_V4|2831 | 31 | 37 | 27 | 11 | | | | | | | | | | | | | | | | | | | | |
| 712 | 939 | B1.0|REF99_V4|1317 | 615 | B1.0|REF99_V4|3374 | 31 | 32 | 24 | 9 | | | | | | | | | | | | | | | | | | | | |
| 713 | 939 | B1.0|REF99_V4|1317 | 916 | B1.0|REF99_V4|3675 | 31 | 37 | 27 | 11 | | | | | | | | | | | | | | | | | | | | |
| 714 | 939 | B1.0|REF99_V4|1317 | 945 | B1.0|REF99_V4|442 | 31 | 26 | 20 | 8 | | | | | | | | | | | | | | | | | | | | |
| 715 | 939 | B1.0|REF99_V4|1317 | 837 | B1.0|REF99_V4|720 | 31 | 47 | 28 | 14 | | | | | | | | | | | | | | | | | | | | |
| 716 | 939 | B1.0|REF99_V4|1317 | 648 | B1.0|REF99_V4|414 | 34 | 54 | 34 | 17 | | | | | | | | | | | | | | | | | | | | |
| 718 | 71 | B1.0|REF99_V4|1351 | 59 | B1.0|REF99_V4|171149 | 34 | 20 | 18 | 6 | | | | | | | | | | | | | | | | | | | | |
| 720 | 71 | B1.0|REF99_V4|1351 | 313 | B1.0|REF99_V4|18024 | 34 | 21 | 20 | 7 | | | | | | | | | | | | | | | | | | | | |
| 721 | 71 | B1.0|REF99_V4|1351 | 656 | B1.0|REF99_V4|191 | 34 | 38 | 28 | 12 | | | | | | | | | | | | | | | | | | | | |
| 722 | 71 | B1.0|REF99_V4|1351 | 613 | B1.0|REF99_V4|2200 | 34 | 23 | 22 | 7 | | | | | | | | | | | | | | | | | | | | |
| 723 | 71 | B1.0|REF99_V4|1351 | 681 | B1.0|REF99_V4|234 | 34 | 41 | 25 | 13 | | | | | | | | | | | | | | | | | | | | |
| 724 | 71 | B1.0|REF99_V4|1351 | 683 | B1.0|REF99_V4|2385 | 34 | 20 | 20 | 6 | | | | | | | | | | | | | | | | | | | | |
| 726 | 71 | B1.0|REF99_V4|1351 | 961 | B1.0|REF99_V4|3580 | 34 | 23 | 22 | 7 | | | | | | | | | | | | | | | | | | | | |
| 728 | 71 | B1.0|REF99_V4|1351 | 945 | B1.0|REF99_V4|442 | 34 | 26 | 23 | 8 | | | | | | | | | | | | | | | | | | | | |
| 729 | 71 | B1.0|REF99_V4|1351 | 734 | B1.0|REF99_V4|558 | 34 | 31 | 22 | 10 | | | | | | | | | | | | | | | | | | | | |
| 730 | 71 | B1.0|REF99_V4|1351 | 319 | B1.0|REF99_V4|70731 | 34 | 25 | 23 | 8 | | | | | | | | | | | | | | | | | | | | |
| 731 | 1013 | B1.0|REF99_V4|13951 | 789 | B1.0|REF99_V4|2172 | 22 | 38 | 20 | 8 | | | | | | | | | | | | | | | | | | | | |
| 733 | 1013 | B1.0|REF99_V4|13951 | 974 | B1.0|REF99_V4|2831 | 22 | 37 | 22 | 8 | | | | | | | | | | | | | | | | | | | | |
| 734 | 1013 | B1.0|REF99_V4|13951 | 916 | B1.0|REF99_V4|3675 | 22 | 37 | 22 | 8 | | | | | | | | | | | | | | | | | | | | |
| 735 | 648 | B1.0|REF99_V4|414 | 789 | B1.0|REF99_V4|2172 | 54 | 38 | 37 | 19 | | | | | | | | | | | | | | | | | | | | |
| 736 | 648 | B1.0|REF99_V4|414 | 810 | B1.0|REF99_V4|250 | 54 | 26 | 26 | 13 | | | | | | | | | | | | | | | | | | | | |

TABLE 14-continued

| A PAIR | B (SEQ ID) Endophyte 1 | C Endophyte 1 (OTU) | D (SEQ ID) Endophyte 2 | E Endophyte 2 (OTU) | F Bacteria - dicots | | | | G Bacteria - dicots, roots | | | | H Bacteria - dicots, seeds | | | | I Fungi - dicots | | | | J Fungi - dicots, roots | | | | K Fungi - dicots, seeds | | | |
|---|---|---|---|---|---|---|---|---|---|---|---|---|---|---|---|---|---|---|---|---|---|---|---|---|---|---|---|---|
| | | | | | N1 | N2 | OC | EC | N1 | N2 | OC | EC | N1 | N2 | OC | EC | N1 | N2 | OC | EC | N1 | N2 | OC | EC | N1 | N2 | OC | EC |
| 737 | 648 | B1.0|REF99_V4|414 | 615 | B1.0|REF99_V4|3374 | 54 | 32 | 32 | 16 | | | | | 19 | 14 | 11 | 4 | | | | | | | | | | | | |
| 739 | 1091 | B1.0|REF99_V4|415 | 1092 | B1.0|REF99_V4|76 | | | | | | | | | | | | | | | | | | | | | | | | |
| 742 | 116 | B1.0|REF99_V4|1567 | 131 | B1.0|REF99_V4|251 | 29 | 30 | 20 | 8 | | | | | | | | | | | | | | | | | | | | |
| 745 | 116 | B1.0|REF99_V4|1567 | 945 | B1.0|REF99_V4|442 | 29 | 26 | 20 | 7 | | | | | | | | | | | | | | | | | | | | |
| 749 | 1180 | B1.0|REF99_V4|166 | 789 | B1.0|REF99_V4|2172 | 49 | 38 | 33 | 17 | | | | | | | | | | | | | | | | | | | | |
| 761 | 59 | B1.0|REF99_V4|171149 | 789 | B1.0|REF99_V4|2172 | 20 | 38 | 19 | 7 | | | | | | | | | | | | | | | | | | | | |
| 762 | 59 | B1.0|REF99_V4|171149 | 974 | B1.0|REF99_V4|2831 | 20 | 37 | 20 | 7 | | | | | | | | | | | | | | | | | | | | |
| 763 | 59 | B1.0|REF99_V4|171149 | 916 | B1.0|REF99_V4|3675 | 20 | 37 | 20 | 7 | | | | | | | | | | | | | | | | | | | | |
| 774 | 313 | B1.0|REF99_V4|18024 | 789 | B1.0|REF99_V4|2172 | 21 | 38 | 21 | 8 | | | | | | | | | | | | | | | | | | | | |
| 775 | 313 | B1.0|REF99_V4|18024 | 974 | B1.0|REF99_V4|2831 | 21 | 37 | 21 | 7 | | | | | | | | | | | | | | | | | | | | |
| 776 | 313 | B1.0|REF99_V4|18024 | 615 | B1.0|REF99_V4|3374 | 21 | 32 | 21 | 6 | | | | | | | | | | | | | | | | | | | | |
| 777 | 313 | B1.0|REF99_V4|18024 | 713 | B1.0|REF99_V4|754 | 21 | 37 | 20 | 7 | | | | | | | | | | | | | | | | | | | | |
| 778 | 889 | B1.0|REF99_V4|185 | 1011 | B1.0|REF99_V4|2104 | 28 | 32 | 20 | 8 | | | | | | | | | | | | | | | | | | | | |
| 780 | 889 | B1.0|REF99_V4|185 | 615 | B1.0|REF99_V4|3374 | 28 | 32 | 23 | 8 | | | | | | | | | | | | | | | | | | | | |
| 783 | 656 | B1.0|REF99_V4|191 | 810 | B1.0|REF99_V4|250 | 32 | 26 | 23 | 9 | | | | | | | | | | | | | | | | | | | | |
| 784 | 656 | B1.0|REF99_V4|191 | 131 | B1.0|REF99_V4|251 | 38 | 30 | 24 | 11 | | | | | | | | | | | | | | | | | | | | |
| 785 | 656 | B1.0|REF99_V4|191 | 615 | B1.0|REF99_V4|3374 | 38 | 32 | 27 | 11 | | | | | | | | | | | | | | | | | | | | |
| 787 | 1011 | B1.0|REF99_V4|2104 | 681 | B1.0|REF99_V4|234 | 32 | 41 | 25 | 12 | | | | | | | | | | | | | | | | | | | | |
| 788 | 1011 | B1.0|REF99_V4|2104 | 945 | B1.0|REF99_V4|442 | 32 | 26 | 22 | 8 | | | | | | | | | | | | | | | | | | | | |
| 789 | 789 | B1.0|REF99_V4|2172 | 613 | B1.0|REF99_V4|2200 | 38 | 23 | 22 | 8 | | | | | | | | | | | | | | | | | | | | |
| 791 | 789 | B1.0|REF99_V4|2172 | 683 | B1.0|REF99_V4|2385 | 38 | 20 | 19 | 7 | | | | | | | | | | | | | | | | | | | | |
| 793 | 789 | B1.0|REF99_V4|2172 | 945 | B1.0|REF99_V4|442 | 26 | 26 | 25 | 9 | | | | | | | | | | | | | | | | | | | | |
| 794 | 789 | B1.0|REF99_V4|2172 | 60 | B1.0|REF99_V4|514 | 38 | 22 | 21 | 8 | | | | | | | | | | | | | | | | | | | | |
| 796 | 789 | B1.0|REF99_V4|2172 | 734 | B1.0|REF99_V4|558 | 38 | 31 | 24 | 11 | | | | | | | | | | | | | | | | | | | | |
| 797 | 789 | B1.0|REF99_V4|2172 | 319 | B1.0|REF99_V4|170731 | 38 | 25 | 24 | 9 | | | | | | | | | | | | | | | | | | | | |
| 798 | 613 | B1.0|REF99_V4|2200 | 974 | B1.0|REF99_V4|2831 | 23 | 37 | 23 | 8 | | | | | | | | | | | | | | | | | | | | |
| 799 | 613 | B1.0|REF99_V4|2200 | 615 | B1.0|REF99_V4|3374 | 23 | 32 | 21 | 7 | | | | | | | | | | | | | | | | | | | | |
| 800 | 613 | B1.0|REF99_V4|2200 | 916 | B1.0|REF99_V4|3675 | 23 | 37 | 23 | 8 | | | | | | | | | | | | | | | | | | | | |
| 801 | 613 | B1.0|REF99_V4|2200 | 713 | B1.0|REF99_V4|754 | 23 | 37 | 22 | 8 | | | | | | | | | | | | | | | | | | | | |
| 802 | 613 | B1.0|REF99_V4|2200 | 915 | B1.0|REF99_V4|884 | 38 | 33 | 23 | 7 | | | | | | | | | | | | | | | | | | | | |
| 803 | 613 | B1.0|REF99_V4|2200 | 1007 | B1.0|REF99_V4|9526 | 23 | 39 | 23 | 8 | | | | | | | | | | | | | | | | | | | | |
| 804 | 887 | B1.0|REF99_V4|2238 | 974 | B1.0|REF99_V4|2831 | 23 | 37 | 19 | 7 | | | | | | | | | | | | | | | | | | | | |
| 806 | 681 | B1.0|REF99_V4|234 | 974 | B1.0|REF99_V4|2831 | 19 | 37 | 27 | 14 | | | | | | | | | | | | | | | | | | | | |
| 807 | 681 | B1.0|REF99_V4|234 | 916 | B1.0|REF99_V4|3675 | 41 | 37 | 27 | 14 | | | | | | | | | | | | | | | | | | | | |
| 808 | 681 | B1.0|REF99_V4|234 | 719 | B1.0|REF99_V4|385 | 41 | 41 | 28 | 16 | | | | | | | | | | | | | | | | | | | | |
| 809 | 681 | B1.0|REF99_V4|234 | 818 | B1.0|REF99_V4|531 | 41 | 30 | 23 | 12 | | | | | | | | | | | | | | | | | | | | |
| 810 | 681 | B1.0|REF99_V4|234 | 1012 | B1.0|REF99_V4|597 | 41 | 34 | 24 | 13 | | | | | | | | | | | | | | | | | | | | |
| 811 | 681 | B1.0|REF99_V4|234 | 1007 | B1.0|REF99_V4|9526 | 41 | 39 | 26 | 15 | | | | | | | | | | | | | | | | | | | | |
| 812 | 683 | B1.0|REF99_V4|2385 | 916 | B1.0|REF99_V4|3675 | 20 | 37 | 20 | 7 | | | | | | | | | | | | | | | | | | | | |
| 815 | 683 | B1.0|REF99_V4|2385 | 1007 | B1.0|REF99_V4|9526 | 20 | 39 | 19 | 7 | | | | | | | | | | | | | | | | | | | | |
| 816 | 810 | B1.0|REF99_V4|250 | 131 | B1.0|REF99_V4|251 | 26 | 30 | 19 | 7 | | | | | | | | | | | | | | | | | | | | |
| 817 | 810 | B1.0|REF99_V4|250 | 963 | B1.0|REF99_V4|33855 | 26 | 36 | 22 | 9 | | | | | | | | | | | | | | | | | | | | |
| 819 | 810 | B1.0|REF99_V4|250 | 945 | B1.0|REF99_V4|442 | 26 | 26 | 17 | 6 | | | | | | | | | | | | | | | | | | | | |
| 821 | 810 | B1.0|REF99_V4|250 | 69 | B1.0|REF99_V4|506 | 26 | 31 | 20 | 8 | | | | | | | | | | | | | | | | | | | | |
| 822 | 810 | B1.0|REF99_V4|250 | 60 | B1.0|REF99_V4|514 | 26 | 22 | 17 | 5 | | | | | | | | | | | | | | | | | | | | |
| 823 | 810 | B1.0|REF99_V4|250 | 734 | B1.0|REF99_V4|558 | 26 | 31 | 19 | 8 | | | | | | | | | | | | | | | | | | | | |
| 825 | | | | | | | | | | | | | | | | | | | | | | | | | | | | |

TABLE 14-continued

| A PAIR | B (SEQ ID) | C Endophyte 1 (OTU) | D Endophyte 2 (SEQ ID) | E Endophyte 2 (OTU) | F Bacteria - dicots | | | | G Bacteria - dicots, roots | | | | H Bacteria - dicots, seeds | | | | I Fungi - dicots | | | | J Fungi - dicots, roots | | | | K Fungi - dicots, seeds | | | |
|---|---|---|---|---|---|---|---|---|---|---|---|---|---|---|---|---|---|---|---|---|---|---|---|---|---|---|---|---|
| | | | | | N1 | N2 | OC | EC | N1 | N2 | OC | EC | N1 | N2 | OC | EC | N1 | N2 | OC | EC | N1 | N2 | OC | EC | N1 | N2 | OC | EC |
| 827 | 810 | B1.0\|REF99_V4\|250 | 319 | B1.0\|REF99_V4\|70731 | 26 | 25 | 18 | 6 | | | | | | | | | | | | | | | | | | | | |
| 828 | 131 | B1.0\|REF99_V4\|251 | 943 | B1.0\|REF99_V4\|26030 | 30 | 30 | 21 | 8 | | | | | | | | | | | | | | | | | | | | |
| 829 | 131 | B1.0\|REF99_V4\|251 | 963 | B1.0\|REF99_V4\|33855 | 30 | 36 | 25 | 10 | | | | | | | | | | | | | | | | | | | | |
| 832 | 131 | B1.0\|REF99_V4\|251 | 915 | B1.0\|REF99_V4\|4884 | 30 | 33 | 25 | 9 | | | | | | | | | | | | | | | | | | | | |
| 833 | 943 | B1.0\|REF99_V4\|26030 | 945 | B1.0\|REF99_V4\|4442 | 26 | 29 | 20 | 7 | | | | | | | | | | | | | | | | | | | | |
| 837 | 974 | B1.0\|REF99_V4\|2831 | 734 | B1.0\|REF99_V4\|4558 | 37 | 31 | 24 | 11 | | | | | | | | | | | | | | | | | | | | |
| 845 | 615 | B1.0\|REF99_V4\|3374 | 945 | B1.0\|REF99_V4\|4442 | 32 | 26 | 22 | 8 | | | | | | | | | | | | | | | | | | | | |
| 846 | 615 | B1.0\|REF99_V4\|3374 | 60 | B1.0\|REF99_V4\|4514 | 32 | 22 | 20 | 7 | | | | | | | | | | | | | | | | | | | | |
| 847 | 963 | B1.0\|REF99_V4\|33855 | 945 | B1.0\|REF99_V4\|4442 | 36 | 26 | 23 | 9 | | | | | | | | | | | | | | | | | | | | |
| 848 | 963 | B1.0\|REF99_V4\|33855 | 837 | B1.0\|REF99_V4\|4720 | 36 | 47 | 33 | 16 | | | | | | | | | | | | | | | | | | | | |
| 849 | 963 | B1.0\|REF99_V4\|33855 | 915 | B1.0\|REF99_V4\|4884 | 36 | 33 | 31 | 11 | | | | | | | | | | | | | | | | | | | | |
| 850 | 961 | B1.0\|REF99_V4\|3580 | 916 | B1.0\|REF99_V4\|43675 | 23 | 37 | 23 | 8 | | | | | | | | | | | | | | | | | | | | |
| 851 | 961 | B1.0\|REF99_V4\|3580 | 1007 | B1.0\|REF99_V4\|49526 | 23 | 39 | 21 | 8 | | | | | | | | | | | | | | | | | | | | |
| 853 | 916 | B1.0\|REF99_V4\|43675 | 60 | B1.0\|REF99_V4\|4514 | 37 | 22 | 22 | 8 | | | | | | | | | | | | | | | | | | | | |
| 855 | 916 | B1.0\|REF99_V4\|43675 | 734 | B1.0\|REF99_V4\|4558 | 37 | 31 | 24 | 11 | | | | | | | | | | | | | | | | | | | | |
| 858 | 719 | B1.0\|REF99_V4\|4385 | 837 | B1.0\|REF99_V4\|4720 | 41 | 47 | 30 | 18 | | | | | | | | | | | | | | | | | | | | |
| 860 | 945 | B1.0\|REF99_V4\|4442 | 837 | B1.0\|REF99_V4\|4720 | 26 | 47 | 26 | 11 | | | | | | | | | | | | | | | | | | | | |
| 861 | 945 | B1.0\|REF99_V4\|4442 | 713 | B1.0\|REF99_V4\|4754 | 26 | 37 | 24 | 9 | | | | | | | | | | | | | | | | | | | | |
| 862 | 945 | B1.0\|REF99_V4\|4442 | 1007 | B1.0\|REF99_V4\|49526 | 26 | 39 | 24 | 10 | | | | | | | | | | | | | | | | | | | | |
| 866 | 60 | B1.0\|REF99_V4\|4514 | 1012 | B1.0\|REF99_V4\|4597 | 22 | 34 | 21 | 7 | | | | | | | | | | | | | | | | | | | | |
| 867 | 60 | B1.0\|REF99_V4\|4514 | 837 | B1.0\|REF99_V4\|4720 | 22 | 47 | 22 | 10 | | | | | | | | | | | | | | | | | | | | |
| 868 | 60 | B1.0\|REF99_V4\|4514 | 1007 | B1.0\|REF99_V4\|49526 | 22 | 39 | 21 | 8 | | | | | | | | | | | | | | | | | | | | |
| 869 | 818 | B1.0\|REF99_V4\|4531 | 1007 | B1.0\|REF99_V4\|49526 | 30 | 39 | 22 | 11 | | | | | | | | | | | | | | | | | | | | |
| 870 | 734 | B1.0\|REF99_V4\|4558 | 1012 | B1.0\|REF99_V4\|4597 | 31 | 47 | 30 | 10 | | | | | | | | | | | | | | | | | | | | |
| 871 | 734 | B1.0\|REF99_V4\|4558 | 837 | B1.0\|REF99_V4\|4720 | 31 | 47 | 27 | 14 | | | | | | | | | | | | | | | | | | | | |
| 872 | 734 | B1.0\|REF99_V4\|4558 | 713 | B1.0\|REF99_V4\|4754 | 31 | 37 | 23 | 11 | | | | | | | | | | | | | | | | | | | | |
| 873 | 734 | B1.0\|REF99_V4\|4558 | 1007 | B1.0\|REF99_V4\|49526 | 31 | 39 | 24 | 11 | | | | | | | | | | | | | | | | | | | | |
| 874 | 1012 | B1.0\|REF99_V4\|4597 | 319 | B1.0\|REF99_V4\|70731 | 34 | 25 | 24 | 8 | | | | | | | | | | | | | | | | | | | | |
| 877 | 319 | B1.0\|REF99_V4\|70731 | 837 | B1.0\|REF99_V4\|4720 | 25 | 47 | 25 | 11 | | | | | | | | | | | | | | | | | | | | |
| 878 | 319 | B1.0\|REF99_V4\|70731 | 713 | B1.0\|REF99_V4\|4754 | 25 | 37 | 23 | 9 | | | | | | | | | | | | | | | | | | | | |
| 896 | 892 | B1.0\|REF99_V4\|11177 | 653 | B1.0\|REF99_V4\|4995 | 25 | 26 | 19 | 6 | | | | | | | | | | | | | | | | | | | | |
| 899 | 121 | B1.0\|REF99_V4\|11211 | 957 | B1.0\|REF99_V4\|4921 | 31 | 40 | 23 | 12 | | | | | 22 | 27 | 16 | 9 | | | | | | | | | | | | |
| 903 | 939 | B1.0\|REF99_V4\|11317 | 1177 | B1.0\|REF99_V4\|464 | | | | | 14 | 11 | 8 | 4 | | | | | | | | | | | | | | | | |
| 906 | 628 | B1.0\|REF99_V4\|136920 | 334 | B1.0\|REF99_V4\|19277 | | | | | 23 | 26 | 20 | 16 | | | | | | | | | | | | | | | | |
| 907 | 260 | B1.0\|REF99_V4\|14662 | 739 | B1.0\|REF99_V4\|41562 | 39 | 28 | 22 | 10 | | | | 6 | | | | 17 | | | | | | | | | | | | |
| 909 | 739 | B1.0\|REF99_V4\|41562 | 313 | B1.0\|REF99_V4\|18024 | 28 | 21 | 18 | 6 | | | | | | | | | | | | | | | | | | | | |
| 911 | 739 | B1.0\|REF99_V4\|41562 | 719 | B1.0\|REF99_V4\|4385 | | | | | 26 | 24 | 21 | 8 | | | | 17 | | | | | | | | | | | | |
| 920 | 812 | B1.0\|REF99_V4\|42419 | 665 | B1.0\|REF99_V4\|4446 | | | | | 12 | 25 | 12 | 16 | | | | 8 | | | | | | | | | | | | |
| 921 | 1221 | B1.0\|REF99_V4\|42512 | 665 | B1.0\|REF99_V4\|4446 | | | | 6 | 24 | 25 | 25 | 21 | | | | 16 | | | | | | | | | | | | |
| 925 | 961 | B1.0\|REF99_V4\|3580 | 853 | B1.0\|REF99_V4\|45965 | | | | 5 | 23 | 22 | 18 | | | | | 14 | | | | | | | | | | | | |
| 933 | 1108 | B1.0\|REF99_V4\|41 | 1086 | B1.0\|REF99_V4\|25794 | | | | | | | | | 16 | 21 | 14 | 5 | | | | | | | | | | | | | |
| 938 | 1191 | B1.0\|REF97_V4\|150716 | 1158 | B1.0\|REF99_V4\|11323 | | | | | | | | | 22 | 30 | 17 | 9 | | | | | | | | | | | | | |
| 940 | 566 | B1.0\|REF97_V4\|16938 | 563 | B1.0\|REF99_V4\|44943 | | | | | 26 | 24 | 25 | 21 | 12 | 13 | 11 | 2 | | | | | | | | | | | | | |
| 941 | 566 | B1.0\|REF97_V4\|16938 | 566 | B1.0\|REF99_V4\|16938 | | | | | 12 | 25 | 21 | 12 | 12 | 19 | 12 | 3 | | | | | | | | | | | | | |
| 942 | 566 | B1.0\|REF97_V4\|16938 | 568 | B1.0\|REF99_V4\|1285 | | | | | 24 | 25 | 21 | 16 | 12 | 19 | 12 | 3 | | | | | | | | | | | | | |
| 943 | 566 | B1.0\|REF97_V4\|16938 | 563 | B1.0\|REF99_V4\|44943 | | | | | 23 | 22 | 18 | 14 | 12 | 13 | 11 | 2 | | | | | | | | | | | | | |

TABLE 14-continued

| PAIR | B Endophyte 1 (SEQ ID) | C Endophyte 1 (OTU) | D Endophyte 2 (SEQ ID) | E Endophyte 2 (OTU) | F Bacteria - dicots | | | | G Bacteria - dicots, roots | | | | H Bacteria - dicots, seeds | | | | I Fungi - dicots | | | | J Fungi - dicots, roots | | | | K Fungi - dicots, seeds | | | |
|---|---|---|---|---|---|---|---|---|---|---|---|---|---|---|---|---|---|---|---|---|---|---|---|---|---|---|---|---|
| | | | | | N1 | N2 | OC | EC | N1 | N2 | OC | EC | N1 | N2 | OC | EC | N1 | N2 | OC | EC | N1 | N2 | OC | EC | N1 | N2 | OC | EC |
| 944 | 1098 | B1.0\|REF97_V4\|171 | 1091 | B1.0\|REF97_V4\|171 | | | | | | | | | 14 | 19 | 11 | 4 | | | | | | | | | | | | |
| 949 | 563 | B1.0\|REF97_V4\|44943 | 566 | B1.0\|REF99_V4\|16938 | | | | | | | | | 13 | 19 | 12 | 4 | | | | | | | | | | | | |
| 950 | 563 | B1.0\|REF97_V4\|44943 | 564 | B1.0\|REF99_V4\|13624 | | | | | | | | | 13 | 17 | 11 | 3 | | | | | | | | | | | | |
| 965 | 512 | B1.0\|REF99_V4\|15428 | 505 | B1.0\|REF99_V4\|7082 | 18 | 17 | 14 | 3 | | | | | 18 | 17 | 14 | 4 | | | | | | | | | | | | |
| 966 | 566 | B1.0\|REF99_V4\|16938 | 568 | B1.0\|REF99_V4\|285 | | | | | | | | | 19 | 19 | 14 | 5 | | | | | | | | | | | | |
| 967 | 566 | B1.0\|REF99_V4\|16938 | 564 | B1.0\|REF99_V4\|13624 | 19 | 17 | 14 | 3 | | | | | 19 | 17 | 14 | 5 | | | | | | | | | | | | |
| 968 | 684 | B1.0\|REF99_V4\|172 | 702 | B1.0\|REF99_V4\|15579 | | | | | | | | | 43 | 32 | 28 | 20 | | | | | | | | | | | | |
| 970 | 684 | B1.0\|REF99_V4\|172 | 1134 | B1.0\|REF99_V4\|1986 | | | | | | | | | 43 | 31 | 27 | 19 | | | | | | | | | | | | |
| 978 | 1086 | B1.0\|REF99_V4\|25794 | 1094 | B1.0\|REF99_V4\|387 | | | | | | | | | 21 | 15 | 12 | 5 | | | | | | | | | | | | |
| 980 | 1094 | B1.0\|REF99_V4\|387 | 1092 | B1.0\|REF99_V4\|476 | | | | | | | | | 15 | 14 | 10 | 3 | | | | | | | | | | | | |
| 981 | 332 | B1.0\|REF97_V4\|10068 | 332 | B1.0\|REF99_V4\|10068 | | | | | 8 | 20 | 8 | 4 | | | | | | | | | | | | | | | | |
| 982 | 1180 | B1.0\|REF97_V4\|166 | 812 | B1.0\|REF99_V4\|12419 | | | | | 16 | 12 | 9 | 5 | | | | | | | | | | | | | | | | |
| 983 | 1180 | B1.0\|REF97_V4\|166 | 621 | B1.0\|REF99_V4\|569 | | | | | 16 | 16 | 11 | 7 | | | | | | | | | | | | | | | | |
| 984 | 1180 | B1.0\|REF97_V4\|166 | 430 | B1.0\|REF99_V4\|659 | | | | | 16 | 13 | 10 | 6 | | | | | | | | | | | | | | | | |
| 985 | 1098 | B1.0\|REF97_V4\|171 | 1158 | B1.0\|REF99_V4\|1323 | | | | | 8 | 14 | 7 | 3 | | | | | | | | | | | | | | | | |
| 986 | 313 | B1.0\|REF97_V4\|18024 | 775 | B1.0\|REF99_V4\|635 | | | | | 21 | 15 | 13 | 9 | | | | | | | | | | | | | | | | |
| 987 | 615 | B1.0\|REF97_V4\|3374 | 313 | B1.0\|REF99_V4\|18024 | 26 | 21 | 19 | 5 | 26 | 21 | 19 | 15 | | | | | | | | | | | | | | | | |
| 988 | 615 | B1.0\|REF97_V4\|3374 | 719 | B1.0\|REF99_V4\|385 | 26 | 41 | 21 | 10 | 26 | 24 | 21 | 17 | | | | | | | | | | | | | | | | |
| 989 | 1012 | B1.0\|REF97_V4\|597 | 653 | B1.0\|REF99_V4\|995 | | | | | 14 | 24 | 13 | 9 | | | | | | | | | | | | | | | | |
| 990 | 1106 | B1.0\|REF97_V4\|466 | 939 | B1.0\|REF99_V4\|1317 | 37 | 31 | 22 | 11 | 24 | 27 | 22 | 18 | | | | | | | | | | | | | | | | |
| 991 | 1106 | B1.0\|REF97_V4\|466 | 864 | B1.0\|REF99_V4\|217 | | | | | 24 | 16 | 15 | 10 | | | | | | | | | | | | | | | | |
| 992 | 1106 | B1.0\|REF97_V4\|466 | 1221 | B1.0\|REF99_V4\|2512 | 37 | 24 | 20 | 8 | 24 | 24 | 20 | 16 | | | | | | | | | | | | | | | | |
| 993 | 1162 | B1.0\|REF97_V4\|66750 | 850 | B1.0\|REF99_V4\|11157 | | | | | 14 | 13 | 9 | 5 | | | | | | | | | | | | | | | | |
| 994 | 1162 | B1.0\|REF97_V4\|66750 | 430 | B1.0\|REF99_V4\|659 | | | | | 14 | 13 | 9 | 5 | | | | | | | | | | | | | | | | |
| 995 | 670 | B1.0\|REF99_V4\|10019 | 43 | B1.0\|REF99_V4\|12265 | | | | | 11 | 9 | 9 | 3 | | | | | | | | | | | | | | | | |
| 996 | 944 | B1.0\|REF99_V4\|101700 | 962 | B1.0\|REF99_V4\|102519 | | | | | 15 | 23 | 13 | 9 | | | | | | | | | | | | | | | | |
| 997 | 944 | B1.0\|REF99_V4\|101700 | 691 | B1.0\|REF99_V4\|2533 | | | | | 15 | 9 | 8 | 4 | | | | | | | | | | | | | | | | |
| 998 | 944 | B1.0\|REF99_V4\|101700 | 430 | B1.0\|REF99_V4\|659 | | | | | 15 | 13 | 9 | 5 | | | | | | | | | | | | | | | | |
| 999 | 382 | B1.0\|REF99_V4\|102724 | 879 | B1.0\|REF99_V4\|1349 | | | | | 8 | 10 | 6 | 2 | | | | | | | | | | | | | | | | |
| 1000 | 884 | B1.0\|REF99_V4\|11164 | 1221 | B1.0\|REF99_V4\|2512 | 31 | 24 | 24 | 7 | 31 | 24 | 24 | 20 | | | | | | | | | | | | | | | | |
| 1001 | 54 | B1.0\|REF99_V4\|118524 | 59 | B1.0\|REF99_V4\|171149 | | | | | 16 | 20 | 13 | 9 | | | | | | | | | | | | | | | | |
| 1002 | 839 | B1.0\|REF99_V4\|11186 | 814 | B1.0\|REF99_V4\|11673 | | | | | 19 | 14 | 11 | 7 | | | | | | | | | | | | | | | | |
| 1003 | 1245 | B1.0\|REF99_V4\|12375 | 405 | B1.0\|REF99_V4\|13726 | | | | | 11 | 11 | 7 | 3 | | | | | | | | | | | | | | | | |
| 1004 | 1245 | B1.0\|REF99_V4\|12375 | 1248 | B1.0\|REF99_V4\|1792 | | | | | 11 | 16 | 9 | 5 | | | | | | | | | | | | | | | | |
| 1005 | 1245 | B1.0\|REF99_V4\|12375 | 719 | B1.0\|REF99_V4\|385 | | | | | 15 | 24 | 11 | 7 | | | | | | | | | | | | | | | | |
| 1006 | 1245 | B1.0\|REF99_V4\|12375 | 529 | B1.0\|REF99_V4\|43983 | | | | | 15 | 17 | 9 | 4 | | | | | | | | | | | | | | | | |
| 1007 | 1245 | B1.0\|REF99_V4\|12375 | 388 | B1.0\|REF99_V4\|45893 | | | | | 15 | 13 | 9 | 4 | | | | | | | | | | | | | | | | |
| 1008 | 1245 | B1.0\|REF99_V4\|12375 | 430 | B1.0\|REF99_V4\|659 | | | | | 15 | 14 | 8 | 4 | | | | | | | | | | | | | | | | |
| 1009 | 1245 | B1.0\|REF99_V4\|12375 | 968 | B1.0\|REF99_V4\|4972 | | | | | 8 | 13 | 8 | 4 | | | | | | | | | | | | | | | | |
| 1010 | 1158 | B1.0\|REF99_V4\|1323 | 845 | B1.0\|REF99_V4\|42959 | | | | | 11 | 19 | 10 | 6 | | | | | | | | | | | | | | | | |
| 1011 | 1158 | B1.0\|REF99_V4\|1323 | 621 | B1.0\|REF99_V4\|569 | | | | | 14 | 16 | 10 | 6 | | | | | | | | | | | | | | | | |
| 1012 | 879 | B1.0\|REF99_V4\|1349 | 812 | B1.0\|REF99_V4\|12419 | | | | | 14 | 16 | 12 | 7 | | | | | | | | | | | | | | | | |
| 1013 | 879 | B1.0\|REF99_V4\|1349 | 316 | B1.0\|REF99_V4\|25282 | | | | | 10 | 8 | 6 | 2 | | | | | | | | | | | | | | | | |
| 1014 | 1013 | B1.0\|REF99_V4\|13951 | 887 | B1.0\|REF99_V4\|12238 | 22 | 19 | 15 | 4 | 22 | 19 | 15 | 11 | | | | | | | | | | | | | | | | |
| 1015 | 1013 | B1.0\|REF99_V4\|13951 | 818 | B1.0\|REF99_V4\|531 | | | | | 22 | 19 | 15 | 11 | | | | | | | | | | | | | | | | |
| 1016 | 1013 | B1.0\|REF99_V4\|13951 | 994 | B1.0\|REF99_V4\|18340 | | | | | 22 | 14 | 13 | 8 | | | | | | | | | | | | | | | | |

TABLE 14-continued

| A PAIR | B Endophyte 1 (SEQ ID) | C Endophyte 1 (OTU) | D Endophyte 2 (SEQ ID) | E Endophyte 2 (OTU) | F Bacteria - dicots | | | | G Bacteria - dicots, roots | | | | H Bacteria - dicots, seeds | | | | I Fungi - dicots | | | | J Fungi - dicots, roots | | | | K Fungi - dicots, seeds | | | |
|---|---|---|---|---|---|---|---|---|---|---|---|---|---|---|---|---|---|---|---|---|---|---|---|---|---|---|---|---|
| | | | | | N1 | N2 | OC | EC | N1 | N2 | OC | EC | N1 | N2 | OC | EC | N1 | N2 | OC | EC | N1 | N2 | OC | EC | N1 | N2 | OC | EC |
| 1017 | 739 | B1.0│REF99_V4│1562 | 864 | B1.0│REF99_V4│217 | | | | | 26 | 16 | 15 | 11 | | | | | | | | | | | | | | | | |
| 1018 | 858 | B1.0│REF99_V4│17011 | 922 | B1.0│REF99_V4│18254 | | | | | 8 | 6 | 5 | 1 | | | | | | | | | | | | | | | | |
| 1019 | 1248 | B1.0│REF99_V4│1792 | 1221 | B1.0│REF99_V4│2512 | | | | | 16 | 24 | 15 | 10 | | | | | | | | | | | | | | | | |
| 1020 | 1248 | B1.0│REF99_V4│1792 | 665 | B1.0│REF99_V4│446 | | | | | 16 | 25 | 15 | 11 | | | | | | | | | | | | | | | | |
| 1021 | 313 | B1.0│REF99_V4│18024 | 864 | B1.0│REF99_V4│217 | | | | | 21 | 16 | 13 | 9 | | | | | | | | | | | | | | | | |
| 1022 | 313 | B1.0│REF99_V4│18024 | 621 | B1.0│REF99_V4│569 | | | | | 21 | 16 | 13 | 9 | | | | | | | | | | | | | | | | |
| 1023 | 613 | B1.0│REF99_V4│2200 | 818 | B1.0│REF99_V4│531 | | | | | 23 | 19 | 16 | 12 | | | | | | | | | | | | | | | | |
| 1024 | 812 | B1.0│REF99_V4│2419 | 430 | B1.0│REF99_V4│659 | | | | | 12 | 13 | 8 | 4 | | | | | | | | | | | | | | | | |
| 1025 | 316 | B1.0│REF99_V4│25282 | 968 | B1.0│REF99_V4│972 | | | | | 8 | 19 | 8 | 4 | | | | | | | | | | | | | | | | |
| 1026 | 719 | B1.0│REF99_V4│385 | 388 | B1.0│REF99_V4│5893 | | | | | 24 | 14 | 14 | 9 | | | | | | | | | | | | | | | | |
| 1027 | 719 | B1.0│REF99_V4│385 | 968 | B1.0│REF99_V4│972 | | | | | 24 | 19 | 16 | 12 | | | | | | | | | | | | | | | | |
| 1028 | 529 | B1.0│REF99_V4│3983 | 506 | B1.0│REF99_V4│951 | | | | | 17 | 14 | 11 | 6 | | | | | | | | | | | | | | | | |
| 1029 | 665 | B1.0│REF99_V4│446 | 734 | B1.0│REF99_V4│558 | 25 | 31 | 21 | 7 | 25 | 24 | 21 | 16 | | | | | | | | | | | | | | | | |
| 1030 | 818 | B1.0│REF99_V4│531 | 994 | B1.0│REF99_V4│18340 | | | | | 19 | 14 | 11 | 7 | | | | | | | | | | | | | | | | |
| 1031 | 621 | B1.0│REF99_V4│569 | 430 | B1.0│REF99_V4│659 | | | | | 16 | 13 | 10 | 6 | | | | | | | | | | | | | | | | |
| 1032 | 621 | B1.0│REF99_V4│569 | 968 | B1.0│REF99_V4│972 | | | | | 16 | 19 | 12 | 8 | | | | | | | | | | | | | | | | |
| 1033 | 388 | B1.0│REF99_V4│5893 | 853 | B1.0│REF99_V4│5965 | | | | | 14 | 22 | 13 | 8 | | | | | | | | | | | | | | | | |
| 1034 | 853 | B1.0│REF99_V4│5965 | 653 | B1.0│REF99_V4│995 | 22 | 26 | 18 | 5 | 22 | 24 | 18 | 14 | | | | | | | | | | | | | | | | |
| 1035 | 1108 | B1.0│REF97_V4│1 | 1091 | B1.0│REF99_V4│415 | | | | | | | | | 16 | 19 | 12 | 4 | | | | | | | | | | | | |
| 1036 | 1108 | B1.0│REF97_V4│1 | 1097 | B1.0│REF99_V4│159716 | | | | | | | | | 16 | 13 | 12 | 3 | | | | | | | | | | | | |
| 1037 | 1191 | B1.0│REF97_V4│150716 | 519 | B1.0│REF99_V4│35285 | | | | | | | | | 22 | 16 | 12 | 5 | | | | | | | | | | | | |
| 1038 | 1191 | B1.0│REF97_V4│150716 | 519 | B1.0│REF99_V4│35285 | | | | | | | | | 22 | 22 | 15 | 7 | | | | | | | | | | | | |
| 1039 | 1191 | B1.0│REF97_V4│150716 | 1163 | B1.0│REF99_V4│46806 | | | | | | | | | 22 | 31 | 17 | 10 | | | | | | | | | | | | |
| 1040 | 566 | B1.0│REF97_V4│16938 | 564 | B1.0│REF99_V4│43624 | | | | | | | | | 12 | 10 | 9 | 2 | | | | | | | | | | | | |
| 1041 | 566 | B1.0│REF97_V4│16938 | 564 | B1.0│REF99_V4│43624 | | | | | | | | | 12 | 17 | 11 | 3 | | | | | | | | | | | | |
| 1042 | 566 | B1.0│REF97_V4│16938 | 881 | B1.0│REF99_V4│4434 | | | | | | | | | 12 | 28 | 12 | 5 | | | | | | | | | | | | |
| 1043 | 564 | B1.0│REF97_V4│43624 | 563 | B1.0│REF97_V4│44943 | | | | | | | | | 10 | 13 | 9 | 3 | | | | | | | | | | | | |
| 1044 | 564 | B1.0│REF97_V4│43624 | 568 | B1.0│REF99_V4│1285 | | | | | | | | | 10 | 19 | 10 | 2 | | | | | | | | | | | | |
| 1045 | 564 | B1.0│REF97_V4│43624 | 564 | B1.0│REF99_V4│43624 | | | | | | | | | 10 | 17 | 9 | 2 | | | | | | | | | | | | |
| 1046 | 564 | B1.0│REF97_V4│43624 | 563 | B1.0│REF99_V4│44943 | | | | | | | | | 10 | 13 | 9 | 2 | | | | | | | | | | | | |
| 1047 | 563 | B1.0│REF97_V4│44943 | 568 | B1.0│REF99_V4│1285 | | | | | | | | | 13 | 19 | 11 | 4 | | | | | | | | | | | | |
| 1048 | 563 | B1.0│REF97_V4│44943 | 563 | B1.0│REF99_V4│44943 | | | | | | | | | 13 | 13 | 11 | 2 | | | | | | | | | | | | |
| 1049 | 533 | B1.0│REF97_V4│69685 | 492 | B1.0│REF99_V4│49806 | | | | | | | | | 11 | 13 | 9 | 2 | | | | | | | | | | | | |
| 1050 | 372 | B1.0│REF99_V4│10206 | 648 | B1.0│REF99_V4│414 | | | | | | | | | 26 | 17 | 14 | 6 | | | | | | | | | | | | |
| 1051 | 372 | B1.0│REF99_V4│10206 | 566 | B1.0│REF99_V4│16938 | | | | | | | | | 26 | 19 | 15 | 7 | | | | | | | | | | | | |
| 1052 | 1110 | B1.0│REF99_V4│108549 | 1077 | B1.0│REF99_V4│4209 | | | | | | | | | 18 | 17 | 12 | 4 | | | | | | | | | | | | |
| 1053 | 499 | B1.0│REF99_V4│1098 | 702 | B1.0│REF99_V4│5579 | | | | | | | | | 17 | 32 | 15 | 8 | | | | | | | | | | | | |
| 1054 | 1006 | B1.0│REF99_V4│1100 | 522 | B1.0│REF99_V4│19799 | | | | | | | | | 20 | 14 | 11 | 4 | | | | | | | | | | | | |
| 1055 | 1006 | B1.0│REF99_V4│1100 | 1094 | B1.0│REF99_V4│387 | | | | | | | | | 20 | 15 | 12 | 4 | | | | | | | | | | | | |
| 1056 | 1099 | B1.0│REF99_V4│11708 | 1077 | B1.0│REF99_V4│4209 | | | | | | | | | 15 | 17 | 11 | 4 | | | | | | | | | | | | |
| 1057 | 1099 | B1.0│REF99_V4│11708 | 1093 | B1.0│REF99_V4│429 | | | | | | | | | 15 | 20 | 12 | 4 | | | | | | | | | | | | |
| 1058 | 1266 | B1.0│REF99_V4│121010 | 881 | B1.0│REF99_V4│4434 | | | | | | | | | 12 | 28 | 12 | 5 | | | | | | | | | | | | |
| 1059 | 121 | B1.0│REF99_V4│1211 | 1112 | B1.0│REF99_V4│14460 | | | | | | | | | 22 | 30 | 18 | 9 | | | | | | | | | | | | |
| 1060 | 121 | B1.0│REF99_V4│1211 | 972 | B1.0│REF99_V4│1218 | | | | | | | | | 22 | 34 | 18 | 11 | | | | | | | | | | | | |
| 1061 | 1104 | B1.0│REF99_V4│122519 | 519 | B1.0│REF99_V4│35285 | | | | | | | | | 16 | 22 | 12 | 5 | | | | | | | | | | | | |
| 1062 | 1104 | B1.0│REF99_V4│122519 | 1163 | B1.0│REF99_V4│46806 | | | | | | | | | 16 | 31 | 15 | 7 | | | | | | | | | | | | |

TABLE 14-continued

| A PAIR | B Endophyte 1 (SEQ ID) | C Endophyte 1 (OTU) | D Endophyte 2 (SEQ ID) | E Endophyte 2 (OTU) | F Bacteria - dicots N1 | F N2 | F OC | F EC | G Bacteria - dicots, roots N1 | G N2 | G OC | G EC | H Bacteria - dicots, seeds N1 | H N2 | H OC | H EC | I Fungi - dicots N1 | I N2 | I OC | I EC | J Fungi - dicots, roots N1 | J N2 | J OC | J EC | K Fungi - dicots, seeds N1 | K N2 | K OC | K EC |
|---|---|---|---|---|---|---|---|---|---|---|---|---|---|---|---|---|---|---|---|---|---|---|---|---|---|---|---|---|
| 1063 | 1158 | B1.0iREF99_V4i1323 | 522 | B1.0iREF99_V4i1323 | | | | | | | | | 30 | 14 | 13 | 6 | | | | | | | | | | | | |
| 1064 | 1158 | B1.0iREF99_V4i1323 | 957 | B1.0iREF99_V4i4921 | | | | | | | | | 30 | 27 | 19 | 12 | | | | | | | | | | | | |
| 1065 | 893 | B1.0iREF99_V4i139 | 881 | B1.0iREF99_V4i4434 | | | | | | | | | 15 | 28 | 13 | 6 | | | | | | | | | | | | |
| 1066 | 648 | B1.0iREF99_V4i14 | 881 | B1.0iREF99_V4i4434 | | | | | | | | | 17 | 28 | 14 | 7 | | | | | | | | | | | | |
| 1067 | 1112 | B1.0iREF99_V4i14460 | 960 | B1.0iREF99_V4i4684 | | | | | | | | | 30 | 19 | 17 | 8 | | | | | | | | | | | | |
| 1068 | 260 | B1.0iREF99_V4i14662 | 881 | B1.0iREF99_V4i4434 | | | | | | | | | 16 | 28 | 14 | 6 | | | | | | | | | | | | |
| 1069 | 512 | B1.0iREF99_V4i15428 | 496 | B1.0iREF99_V4i470 | | | | | | | | | 18 | 31 | 16 | 8 | | | | | | | | | | | | |
| 1070 | 1097 | B1.0iREF99_V4i159716 | 1093 | B1.0iREF99_V4i429 | | | | | | | | | 13 | 20 | 12 | 4 | | | | | | | | | | | | |
| 1071 | 1097 | B1.0iREF99_V4i159716 | 1113 | B1.0iREF99_V4i52497 | | | | | | | | | 13 | 12 | 11 | 2 | | | | | | | | | | | | |
| 1072 | 566 | B1.0iREF99_V4i16938 | 567 | B1.0iREF99_V4i21364 | | | | | | | | | 19 | 11 | 10 | 3 | | | | | | | | | | | | |
| 1073 | 566 | B1.0iREF99_V4i16938 | 881 | B1.0iREF99_V4i4434 | 19 | 29 | 18 | 5 | | | | | 19 | 28 | 18 | 8 | | | | | | | | | | | | |
| 1074 | 566 | B1.0iREF99_V4i16938 | 563 | B1.0iREF99_V4i4387 | | | | | | | | | 19 | 13 | 11 | 4 | | | | | | | | | | | | |
| 1075 | 566 | B1.0iREF99_V4i16938 | 187 | B1.0iREF99_V4i444943 | | | | | | | | | 19 | 14 | 11 | 4 | | | | | | | | | | | | |
| 1076 | 1098 | B1.0iREF99_V4i171 | 1086 | B1.0iREF99_V4i25794 | | | | | | | | | 39 | 21 | 19 | 12 | | | | | | | | | | | | |
| 1077 | 1077 | B1.0iREF99_V4i209 | 1086 | B1.0iREF99_V4i25794 | | | | | | | | | 17 | 12 | 10 | 3 | | | | | | | | | | | | |
| 1078 | 522 | B1.0iREF99_V4i19799 | 568 | B1.0iREF99_V4i4285 | | | | | | | | | 14 | 21 | 12 | 4 | | | | | | | | | | | | |
| 1079 | 522 | B1.0iREF99_V4i19799 | 1094 | B1.0iREF99_V4i4387 | | | | | | | | | 14 | 15 | 12 | 3 | | | | | | | | | | | | |
| 1080 | 522 | B1.0iREF99_V4i19799 | 960 | B1.0iREF99_V4i4684 | | | | | | | | | 11 | 19 | 10 | 3 | | | | | | | | | | | | |
| 1081 | 1086 | B1.0iREF99_V4i25794 | 1113 | B1.0iREF99_V4i52497 | | | | | | | | | 14 | 19 | 11 | 4 | | | | | | | | | | | | |
| 1082 | 567 | B1.0iREF99_V4i21364 | 568 | B1.0iREF99_V4i4285 | | | | | | | | | 17 | 20 | 12 | 5 | | | | | | | | | | | | |
| 1083 | 972 | B1.0iREF99_V4i218 | 960 | B1.0iREF99_V4i4684 | | | | | | | | | 34 | 19 | 17 | 9 | | | | | | | | | | | | |
| 1084 | 1086 | B1.0iREF99_V4i25794 | 1083 | B1.0iREF99_V4i26074 | | | | | | | | | 21 | 10 | 10 | 3 | | | | | | | | | | | | |
| 1085 | 1086 | B1.0iREF99_V4i25794 | 1201 | B1.0iREF99_V4i442 | 19 | 29 | 16 | 5 | | | | | 21 | 30 | 16 | 9 | | | | | | | | | | | | |
| 1086 | 1086 | B1.0iREF99_V4i25794 | 1113 | B1.0iREF99_V4i52497 | | | | | | | | | 21 | 12 | 11 | 4 | | | | | | | | | | | | |
| 1087 | 1086 | B1.0iREF99_V4i25794 | 960 | B1.0iREF99_V4i4684 | | | | | | | | | 21 | 19 | 13 | 6 | | | | | | | | | | | | |
| 1088 | 568 | B1.0iREF99_V4i4285 | 564 | B1.0iREF99_V4i3624 | | | | | | | | | 19 | 17 | 13 | 5 | | | | | | | | | | | | |
| 1089 | 568 | B1.0iREF99_V4i4285 | 881 | B1.0iREF99_V4i4434 | | | | | | | | | 19 | 28 | 16 | 8 | | | | | | | | | | | | |
| 1090 | 568 | B1.0iREF99_V4i4285 | 563 | B1.0iREF99_V4i444943 | | | | | | | | | 19 | 13 | 11 | 4 | | | | | | | | | | | | |
| 1091 | 1093 | B1.0iREF99_V4i429 | 1113 | B1.0iREF99_V4i52497 | | | | | | | | | 20 | 12 | 11 | 3 | | | | | | | | | | | | |
| 1092 | 519 | B1.0iREF99_V4i35285 | 1105 | B1.0iREF99_V4i44080 | | | | | | | | | 22 | 17 | 13 | 5 | | | | | | | | | | | | |
| 1093 | 564 | B1.0iREF99_V4i3624 | 881 | B1.0iREF99_V4i4434 | | | | | | | | | 17 | 28 | 15 | 7 | | | | | | | | | | | | |
| 1094 | 1094 | B1.0iREF99_V4i4387 | 960 | B1.0iREF99_V4i4684 | | | | | | | | | 15 | 19 | 13 | 4 | | | | | | | | | | | | |
| 1095 | 1094 | B1.0iREF99_V4i4387 | 957 | B1.0iREF99_V4i4921 | | | | | | | | | 15 | 27 | 15 | 6 | | | | | | | | | | | | |
| 1096 | 1105 | B1.0iREF99_V4i44080 | 1163 | B1.0iREF99_V4i46806 | | | | | | | | | 17 | 31 | 15 | 8 | | | | | | | | | | | | |
| 1097 | 881 | B1.0iREF99_V4i4434 | 181 | B1.0iREF99_V4i4473 | | | | | | | | | 28 | 13 | 13 | 5 | | | | | | | | | | | | |
| 1098 | 881 | B1.0iREF99_V4i4434 | 187 | B1.0iREF99_V4i484 | | | | | | | | | 28 | 14 | 13 | 6 | | | | | | | | | | | | |
| 1099 | 702 | B1.0iREF99_V4i5579 | 527 | B1.0iREF99_V4i466392 | 32 | 31 | 22 | 9 | | | | | 32 | 31 | 22 | 14 | | | | | | | | | | | | |
| 1100 | 702 | B1.0iREF99_V4i5579 | 1163 | B1.0iREF99_V4i46806 | 32 | 32 | 20 | 6 | | | | | 32 | 20 | 19 | 9 | | | | | | | | | | | | |
| 1101 | 702 | B1.0iREF99_V4i5579 | 942 | B1.0iREF99_V4i4825 | | | | | | | | | 32 | 20 | 19 | 9 | | | | | | | | | | | | |
| 1102 | 960 | B1.0iREF99_V4i4684 | 957 | B1.0iREF99_V4i4921 | | | | | | | | | 19 | 27 | 15 | 7 | | | | | | | | | | | | |
| 1103 | 496 | B1.0iREF99_V4i470 | 505 | B1.0iREF99_V4i7082 | | | | | | | | | 31 | 17 | 15 | 8 | | | | | | | | | | | | |
| 1104 | 942 | B1.0iREF99_V4i4825 | 1134 | B1.0iREF99_V4i986 | | | | | | | | | 20 | 31 | 16 | 9 | | | | | | | | | | | | |
| 1105 | 313 | B1.0iREF97_V4i18024 | 615 | B1.0iREF99_V4i3374 | 21 | 26 | 17 | 5 | | | | | | | | | | | | | | | | | | | | |
| 1106 | 313 | B1.0iREF97_V4i18024 | 837 | B1.0iREF99_V4i4720 | 21 | 31 | 19 | 6 | | | | | | | | | | | | | | | | | | | | |
| 1107 | 313 | B1.0iREF97_V4i18024 | 137 | B1.0iREF99_V4i411 | 21 | 48 | 21 | 9 | | | | | | | | | | | | | | | | | | | | |
| 1108 | 313 | B1.0iREF97_V4i18024 | 959 | B1.0iREF99_V4i4126 | 21 | 32 | 18 | 6 | | | | | | | | | | | | | | | | | | | | |

TABLE 14-continued

| A | B | C | D | E | F Bacteria - dicots | | | | G Bacteria - dicots, roots | | | | H Bacteria - dicots, seeds | | | | I Fungi - dicots | | | | J Fungi - dicots, roots | | | | K Fungi - dicots, seeds | | | |
|---|---|---|---|---|---|---|---|---|---|---|---|---|---|---|---|---|---|---|---|---|---|---|---|---|---|---|---|---|
| PAIR | Endophyte 1 (SEQ ID) | Endophyte 1 (OTU) | Endophyte 2 (SEQ ID) | Endophyte 2 (OTU) | N1 | N2 | OC | EC | N1 | N2 | OC | EC | N1 | N2 | OC | EC | N1 | N2 | OC | EC | N1 | N2 | OC | EC | N1 | N2 | OC | EC |
| 1109 | 313 | B1.0ıREF97_V4|18024 | 1011 | B1.0ıREF99_V4|2104 | 21 | 32 | 20 | 6 | | | | | | | | | | | | | | | | | | | | |
| 1110 | 313 | B1.0ıREF97_V4|18024 | 789 | B1.0ıREF99_V4|2172 | 21 | 38 | 20 | 8 | | | | | | | | | | | | | | | | | | | | |
| 1111 | 313 | B1.0ıREF97_V4|18024 | 943 | B1.0ıREF99_V4|26030 | 21 | 30 | 17 | 6 | | | | | | | | | | | | | | | | | | | | |
| 1112 | 313 | B1.0ıREF97_V4|18024 | 615 | B1.0ıREF99_V4|3374 | 21 | 32 | 19 | 6 | | | | | | | | | | | | | | | | | | | | |
| 1113 | 313 | B1.0ıREF97_V4|18024 | 963 | B1.0ıREF99_V4|33855 | 21 | 36 | 20 | 7 | | | | | | | | | | | | | | | | | | | | |
| 1114 | 313 | B1.0ıREF97_V4|18024 | 665 | B1.0ıREF99_V4|4446 | 21 | 25 | 16 | 5 | | | | | | | | | | | | | | | | | | | | |
| 1115 | 313 | B1.0ıREF97_V4|18024 | 69 | B1.0ıREF99_V4|4506 | 21 | 31 | 17 | 6 | | | | | | | | | | | | | | | | | | | | |
| 1116 | 313 | B1.0ıREF97_V4|18024 | 1012 | B1.0ıREF99_V4|4597 | 21 | 34 | 18 | 7 | | | | | | | | | | | | | | | | | | | | |
| 1117 | 313 | B1.0ıREF97_V4|18024 | 837 | B1.0ıREF99_V4|4720 | 21 | 47 | 21 | 9 | | | | | | | | | | | | | | | | | | | | |
| 1118 | 313 | B1.0ıREF97_V4|18024 | 713 | B1.0ıREF99_V4|4754 | 21 | 37 | 20 | 7 | | | | | | | | | | | | | | | | | | | | |
| 1119 | 313 | B1.0ıREF97_V4|18024 | 915 | B1.0ıREF99_V4|4884 | 21 | 33 | 20 | 7 | | | | | | | | | | | | | | | | | | | | |
| 1120 | 313 | B1.0ıREF97_V4|18024 | 1007 | B1.0ıREF99_V4|49526 | 21 | 39 | 20 | 8 | | | | | | | | | | | | | | | | | | | | |
| 1121 | 313 | B1.0ıREF97_V4|18024 | 615 | B1.0ıREF97_V4|3374 | 28 | 26 | 21 | 7 | | | | | | | | | | | | | | | | | | | | |
| 1122 | 1011 | B1.0ıREF97_V4|2104 | 837 | B1.0ıREF97_V4|4720 | 28 | 31 | 22 | 8 | | | | | | | | | | | | | | | | | | | | |
| 1123 | 1011 | B1.0ıREF97_V4|2104 | 1007 | B1.0ıREF97_V4|49526 | 28 | 31 | 22 | 8 | | | | | | | | | | | | | | | | | | | | |
| 1124 | 1011 | B1.0ıREF97_V4|2104 | 962 | B1.0ıREF99_V4|102519 | 28 | 23 | 17 | 6 | | | | | | | | | | | | | | | | | | | | |
| 1125 | 1011 | B1.0ıREF97_V4|2104 | 137 | B1.0ıREF99_V4|111 | 28 | 48 | 28 | 13 | | | | | | | | | | | | | | | | | | | | |
| 1126 | 1011 | B1.0ıREF97_V4|2104 | 884 | B1.0ıREF99_V4|11164 | 28 | 31 | 24 | 8 | | | | | | | | | | | | | | | | | | | | |
| 1127 | 1011 | B1.0ıREF97_V4|2104 | 892 | B1.0ıREF99_V4|11177 | 28 | 25 | 19 | 7 | | | | | | | | | | | | | | | | | | | | |
| 1128 | 1011 | B1.0ıREF97_V4|2104 | 886 | B1.0ıREF99_V4|11287 | 28 | 22 | 17 | 6 | | | | | | | | | | | | | | | | | | | | |
| 1129 | 1011 | B1.0ıREF97_V4|2104 | 939 | B1.0ıREF99_V4|11317 | 28 | 31 | 21 | 8 | | | | | | | | | | | | | | | | | | | | |
| 1130 | 1011 | B1.0ıREF97_V4|2104 | 71 | B1.0ıREF99_V4|11351 | 28 | 34 | 25 | 9 | | | | | | | | | | | | | | | | | | | | |
| 1131 | 1011 | B1.0ıREF97_V4|2104 | 648 | B1.0ıREF99_V4|14 | 28 | 54 | 28 | 14 | | | | | | | | | | | | | | | | | | | | |
| 1132 | 1011 | B1.0ıREF97_V4|2104 | 739 | B1.0ıREF99_V4|11562 | 28 | 28 | 20 | 7 | | | | | | | | | | | | | | | | | | | | |
| 1133 | 1011 | B1.0ıREF97_V4|2104 | 116 | B1.0ıREF99_V4|11567 | 28 | 29 | 20 | 8 | | | | | | | | | | | | | | | | | | | | |
| 1134 | 1011 | B1.0ıREF97_V4|2104 | 1180 | B1.0ıREF99_V4|4166 | 28 | 49 | 25 | 13 | | | | | | | | | | | | | | | | | | | | |
| 1135 | 1011 | B1.0ıREF97_V4|2104 | 656 | B1.0ıREF99_V4|4191 | 28 | 38 | 23 | 10 | | | | | | | | | | | | | | | | | | | | |
| 1136 | 1011 | B1.0ıREF97_V4|2104 | 613 | B1.0ıREF99_V4|42200 | 28 | 25 | 18 | 6 | | | | | | | | | | | | | | | | | | | | |
| 1137 | 1011 | B1.0ıREF97_V4|2104 | 681 | B1.0ıREF99_V4|4234 | 28 | 41 | 23 | 11 | | | | | | | | | | | | | | | | | | | | |
| 1138 | 1011 | B1.0ıREF97_V4|2104 | 810 | B1.0ıREF99_V4|4250 | 28 | 26 | 18 | 7 | | | | | | | | | | | | | | | | | | | | |
| 1139 | 1011 | B1.0ıREF97_V4|2104 | 131 | B1.0ıREF99_V4|4251 | 28 | 30 | 20 | 8 | | | | | | | | | | | | | | | | | | | | |
| 1140 | 1011 | B1.0ıREF97_V4|2104 | 1221 | B1.0ıREF99_V4|42512 | 28 | 24 | 18 | 6 | | | | | | | | | | | | | | | | | | | | |
| 1141 | 1011 | B1.0ıREF97_V4|2104 | 943 | B1.0ıREF99_V4|26030 | 28 | 30 | 23 | 8 | | | | | | | | | | | | | | | | | | | | |
| 1142 | 1011 | B1.0ıREF97_V4|2104 | 615 | B1.0ıREF99_V4|3374 | 28 | 32 | 24 | 8 | | | | | | | | | | | | | | | | | | | | |
| 1143 | 1011 | B1.0ıREF97_V4|2104 | 963 | B1.0ıREF99_V4|33855 | 28 | 36 | 25 | 9 | | | | | | | | | | | | | | | | | | | | |
| 1144 | 1011 | B1.0ıREF97_V4|2104 | 961 | B1.0ıREF99_V4|43580 | 28 | 23 | 18 | 6 | | | | | | | | | | | | | | | | | | | | |
| 1145 | 1011 | B1.0ıREF97_V4|2104 | 945 | B1.0ıREF99_V4|4442 | 28 | 41 | 23 | 11 | | | | | | | | | | | | | | | | | | | | |
| 1146 | 1011 | B1.0ıREF97_V4|2104 | 665 | B1.0ıREF99_V4|4446 | 28 | 26 | 20 | 7 | | | | | | | | | | | | | | | | | | | | |
| 1147 | 1011 | B1.0ıREF97_V4|2104 | 69 | B1.0ıREF99_V4|4506 | 28 | 25 | 19 | 7 | | | | | | | | | | | | | | | | | | | | |
| 1148 | 1011 | B1.0ıREF97_V4|2104 | 60 | B1.0ıREF99_V4|4514 | 28 | 31 | 22 | 8 | | | | | | | | | | | | | | | | | | | | |
| 1149 | 1011 | B1.0ıREF97_V4|2104 | 734 | B1.0ıREF99_V4|4558 | 28 | 22 | 18 | 6 | | | | | | | | | | | | | | | | | | | | |
| 1150 | 1011 | B1.0ıREF97_V4|2104 | 853 | B1.0ıREF99_V4|45965 | 28 | 31 | 19 | 8 | | | | | | | | | | | | | | | | | | | | |
| 1151 | 1011 | B1.0ıREF97_V4|2104 | 319 | B1.0ıREF99_V4|170731 | 28 | 25 | 20 | 7 | | | | | | | | | | | | | | | | | | | | |
| 1152 | 1011 | B1.0ıREF97_V4|2104 | 837 | B1.0ıREF99_V4|4720 | 28 | 47 | 28 | 12 | | | | | | | | | | | | | | | | | | | | |
| 1153 | 1011 | B1.0ıREF97_V4|2104 | 968 | B1.0ıREF99_V4|4972 | 28 | 19 | 16 | 5 | | | | | | | | | | | | | | | | | | | | |
| 1154 | 1011 | B1.0ıREF97_V4|2104 | 353 | B1.0ıREF99_V4|19861 | 28 | 27 | 20 | 7 | | | | | | | | | | | | | | | | | | | | |

TABLE 14-continued

| A PAIR | B Endophyte 1 (SEQ ID) | C Endophyte 1 (OTU) | D Endophyte 2 (SEQ ID) | E Endophyte 2 (OTU) | F Bacteria - dicots | | | G Bacteria - dicots, roots | | | H Bacteria - dicots, seeds | | | I Fungi - dicots | | | J Fungi - dicots, roots | | | K Fungi - dicots, seeds | | |
|---|---|---|---|---|---|---|---|---|---|---|---|---|---|---|---|---|---|---|---|---|---|---|---|
| | | | | | N1 | N2 | OC | EC | N1 | N2 | OC | EC | N1 | N2 | OC | EC | N1 | N2 | OC | EC | N1 | N2 | OC | EC |
| 1155 | 1011 | B1.0|REF97_V4|2104 | 653 | B1.0|REF97_V4|995 | 28 | 26 | 20 | 7 | | | | | | | | | | | | | | | |
| 1156 | 974 | B1.0|REF97_V4|2831 | 1106 | B1.0|REF97_V4|466 | 37 | 37 | 24 | 13 | | | | | | | | | | | | | | | |
| 1157 | 974 | B1.0|REF97_V4|2831 | 332 | B1.0|REF99_V4|10068 | 37 | 20 | 20 | 7 | | | | | | | | | | | | | | | |
| 1158 | 974 | B1.0|REF97_V4|2831 | 1221 | B1.0|REF99_V4|2512 | 37 | 24 | 24 | 8 | | | | | | | | | | | | | | | |
| 1159 | 974 | B1.0|REF97_V4|2831 | 529 | B1.0|REF99_V4|3983 | 37 | 18 | 17 | 6 | | | | | | | | | | | | | | | |
| 1160 | 974 | B1.0|REF97_V4|2831 | 665 | B1.0|REF99_V4|4446 | 37 | 25 | 25 | 9 | | | | | | | | | | | | | | | |
| 1161 | 974 | B1.0|REF97_V4|2831 | 853 | B1.0|REF99_V4|5965 | 37 | 22 | 22 | 8 | | | | | | | | | | | | | | | |
| 1162 | 974 | B1.0|REF97_V4|2831 | 1177 | B1.0|REF99_V4|464 | 37 | 40 | 26 | 14 | | | | | | | | | | | | | | | |
| 1163 | 974 | B1.0|REF97_V4|2831 | 968 | B1.0|REF99_V4|4972 | 37 | 19 | 19 | 7 | | | | | | | | | | | | | | | |
| 1164 | 974 | B1.0|REF97_V4|2831 | 353 | B1.0|REF99_V4|9861 | 37 | 27 | 26 | 9 | | | | | | | | | | | | | | | |
| 1165 | 974 | B1.0|REF97_V4|2831 | 653 | B1.0|REF99_V4|995 | 37 | 26 | 24 | 9 | | | | | | | | | | | | | | | |
| 1166 | 615 | B1.0|REF97_V4|3374 | 916 | B1.0|REF97_V4|3675 | 26 | 33 | 22 | 8 | | | | | | | | | | | | | | | |
| 1167 | 615 | B1.0|REF97_V4|3374 | 837 | B1.0|REF97_V4|720 | 26 | 31 | 21 | 8 | | | | | | | | | | | | | | | |
| 1168 | 615 | B1.0|REF97_V4|3374 | 1007 | B1.0|REF97_V4|9526 | 26 | 31 | 21 | 8 | | | | | | | | | | | | | | | |
| 1169 | 615 | B1.0|REF97_V4|3374 | 332 | B1.0|REF99_V4|10068 | 26 | 20 | 16 | 5 | | | | | | | | | | | | | | | |
| 1170 | 615 | B1.0|REF97_V4|3374 | 962 | B1.0|REF99_V4|102519 | 26 | 23 | 17 | 6 | | | | | | | | | | | | | | | |
| 1171 | 615 | B1.0|REF97_V4|3374 | 137 | B1.0|REF99_V4|11 | 26 | 31 | 21 | 8 | | | | | | | | | | | | | | | |
| 1172 | 615 | B1.0|REF97_V4|3374 | 884 | B1.0|REF99_V4|1164 | 26 | 48 | 26 | 12 | | | | | | | | | | | | | | | |
| 1173 | 615 | B1.0|REF97_V4|3374 | 892 | B1.0|REF99_V4|1177 | 26 | 31 | 23 | 8 | | | | | | | | | | | | | | | |
| 1174 | 615 | B1.0|REF97_V4|3374 | 939 | B1.0|REF99_V4|1317 | 26 | 25 | 17 | 6 | | | | | | | | | | | | | | | |
| 1175 | 615 | B1.0|REF97_V4|3374 | 648 | B1.0|REF99_V4|114 | 26 | 31 | 21 | 8 | | | | | | | | | | | | | | | |
| 1176 | 615 | B1.0|REF97_V4|3374 | 739 | B1.0|REF99_V4|1562 | 26 | 54 | 26 | 13 | | | | | | | | | | | | | | | |
| 1177 | 615 | B1.0|REF97_V4|3374 | 116 | B1.0|REF99_V4|1567 | 26 | 28 | 19 | 7 | | | | | | | | | | | | | | | |
| 1178 | 615 | B1.0|REF97_V4|3374 | 1180 | B1.0|REF99_V4|166 | 26 | 29 | 18 | 7 | | | | | | | | | | | | | | | |
| 1179 | 615 | B1.0|REF97_V4|3374 | 656 | B1.0|REF99_V4|191 | 26 | 49 | 25 | 12 | | | | | | | | | | | | | | | |
| 1180 | 615 | B1.0|REF97_V4|3374 | 789 | B1.0|REF99_V4|2172 | 26 | 38 | 22 | 9 | | | | | | | | | | | | | | | |
| 1181 | 615 | B1.0|REF97_V4|3374 | 613 | B1.0|REF99_V4|2200 | 26 | 38 | 26 | 9 | | | | | | | | | | | | | | | |
| 1182 | 615 | B1.0|REF97_V4|3374 | 810 | B1.0|REF99_V4|4250 | 26 | 23 | 17 | 6 | | | | | | | | | | | | | | | |
| 1183 | 615 | B1.0|REF97_V4|3374 | 131 | B1.0|REF99_V4|4251 | 26 | 26 | 20 | 6 | | | | | | | | | | | | | | | |
| 1184 | 615 | B1.0|REF97_V4|3374 | 1221 | B1.0|REF99_V4|2512 | 26 | 30 | 18 | 7 | | | | | | | | | | | | | | | |
| 1185 | 615 | B1.0|REF97_V4|3374 | 943 | B1.0|REF99_V4|126030 | 26 | 24 | 19 | 6 | | | | | | | | | | | | | | | |
| 1186 | 615 | B1.0|REF97_V4|3374 | 963 | B1.0|REF99_V4|133855 | 26 | 30 | 21 | 7 | | | | | | | | | | | | | | | |
| 1187 | 615 | B1.0|REF97_V4|3374 | 961 | B1.0|REF99_V4|3580 | 26 | 36 | 23 | 9 | | | | | | | | | | | | | | | |
| 1188 | 615 | B1.0|REF97_V4|3374 | 945 | B1.0|REF99_V4|4442 | 26 | 23 | 17 | 6 | | | | | | | | | | | | | | | |
| 1189 | 615 | B1.0|REF97_V4|3374 | 665 | B1.0|REF99_V4|4446 | 26 | 26 | 20 | 6 | | | | | | | | | | | | | | | |
| 1190 | 615 | B1.0|REF97_V4|3374 | 69 | B1.0|REF99_V4|4506 | 26 | 25 | 20 | 6 | | | | | | | | | | | | | | | |
| 1191 | 615 | B1.0|REF97_V4|3374 | 60 | B1.0|REF99_V4|4514 | 26 | 31 | 21 | 8 | | | | | | | | | | | | | | | |
| 1192 | 615 | B1.0|REF97_V4|3374 | 734 | B1.0|REF99_V4|4558 | 26 | 22 | 16 | 5 | | | | | | | | | | | | | | | |
| 1193 | 615 | B1.0|REF97_V4|3374 | 853 | B1.0|REF99_V4|5965 | 26 | 31 | 20 | 8 | | | | | | | | | | | | | | | |
| 1194 | 615 | B1.0|REF97_V4|3374 | 319 | B1.0|REF99_V4|70731 | 26 | 22 | 17 | 5 | | | | | | | | | | | | | | | |
| 1195 | 615 | B1.0|REF97_V4|3374 | 837 | B1.0|REF99_V4|720 | 26 | 25 | 18 | 6 | | | | | | | | | | | | | | | |
| 1196 | 615 | B1.0|REF97_V4|3374 | 713 | B1.0|REF99_V4|754 | 26 | 47 | 26 | 11 | | | | | | | | | | | | | | | |
| 1197 | 615 | B1.0|REF97_V4|3374 | 915 | B1.0|REF99_V4|884 | 26 | 37 | 24 | 9 | | | | | | | | | | | | | | | |
| 1198 | 615 | B1.0|REF97_V4|3374 | 353 | B1.0|REF99_V4|9861 | 26 | 33 | 23 | 8 | | | | | | | | | | | | | | | |
| 1199 | 615 | B1.0|REF97_V4|3374 | 653 | B1.0|REF99_V4|995 | 26 | 27 | 21 | 7 | | | | | | | | | | | | | | | |
| 1200 | 916 | B1.0|REF97_V4|3675 | 332 | B1.0|REF99_V4|10068 | 33 | 20 | 17 | 6 | | | | | | | | | | | | | | | |

TABLE 14-continued

| A PAIR | B Endophyte 1 (SEQ ID) | C Endophyte 1 (OTU) | D Endophyte 2 (SEQ ID) | E Endophyte 2 (OTU) | F Bacteria - dicots | | | | G Bacteria - dicots, roots | | | | H Bacteria - dicots, seeds | | | | I Fungi - dicots | | | | J Fungi - dicots, roots | | | | K Fungi - dicots, seeds | | | |
|---|---|---|---|---|---|---|---|---|---|---|---|---|---|---|---|---|---|---|---|---|---|---|---|---|---|---|---|---|
| | | | | | N1 | N2 | OC | EC | N1 | N2 | OC | EC | N1 | N2 | OC | EC | N1 | N2 | OC | EC | N1 | N2 | OC | EC | N1 | N2 | OC | EC |
| 1201 | 916 | B1.0|REF97_V4|3675 | 962 | B1.0|REF99_V4|102519 | 33 | 23 | 21 | 7 | | | | | | | | | | | | | | | | | | | | |
| 1202 | 916 | B1.0|REF97_V4|3675 | 839 | B1.0|REF99_V4|1186 | 33 | 20 | 18 | 6 | | | | | | | | | | | | | | | | | | | | |
| 1203 | 916 | B1.0|REF97_V4|3675 | 739 | B1.0|REF99_V4|1562 | 33 | 28 | 22 | 9 | | | | | | | | | | | | | | | | | | | | |
| 1204 | 916 | B1.0|REF97_V4|3675 | 1180 | B1.0|REF99_V4|166 | 33 | 49 | 29 | 15 | | | | | | | | | | | | | | | | | | | | |
| 1205 | 916 | B1.0|REF97_V4|3675 | 613 | B1.0|REF99_V4|2200 | 33 | 23 | 21 | 7 | | | | | | | | | | | | | | | | | | | | |
| 1206 | 916 | B1.0|REF97_V4|3675 | 887 | B1.0|REF99_V4|2238 | 33 | 19 | 17 | 6 | | | | | | | | | | | | | | | | | | | | |
| 1207 | 916 | B1.0|REF97_V4|3675 | 683 | B1.0|REF99_V4|2385 | 33 | 20 | 18 | 6 | | | | | | | | | | | | | | | | | | | | |
| 1208 | 916 | B1.0|REF97_V4|3675 | 1221 | B1.0|REF99_V4|2512 | 33 | 24 | 21 | 7 | | | | | | | | | | | | | | | | | | | | |
| 1209 | 916 | B1.0|REF97_V4|3675 | 665 | B1.0|REF99_V4|4446 | 33 | 25 | 22 | 8 | | | | | | | | | | | | | | | | | | | | |
| 1210 | 916 | B1.0|REF97_V4|3675 | 60 | B1.0|REF99_V4|514 | 33 | 22 | 18 | 7 | | | | | | | | | | | | | | | | | | | | |
| 1211 | 916 | B1.0|REF97_V4|3675 | 853 | B1.0|REF99_V4|5965 | 33 | 22 | 20 | 7 | | | | | | | | | | | | | | | | | | | | |
| 1212 | 916 | B1.0|REF97_V4|3675 | 1177 | B1.0|REF99_V4|64 | 33 | 40 | 24 | 12 | | | | | | | | | | | | | | | | | | | | |
| 1213 | 916 | B1.0|REF97_V4|3675 | 968 | B1.0|REF99_V4|972 | 33 | 19 | 17 | 6 | | | | | | | | | | | | | | | | | | | | |
| 1214 | 916 | B1.0|REF97_V4|3675 | 353 | B1.0|REF99_V4|9861 | 33 | 27 | 24 | 8 | | | | | | | | | | | | | | | | | | | | |
| 1215 | 916 | B1.0|REF97_V4|3675 | 653 | B1.0|REF99_V4|995 | 33 | 26 | 22 | 8 | | | | | | | | | | | | | | | | | | | | |
| 1216 | 1106 | B1.0|REF97_V4|466 | 137 | B1.0|REF99_V4|11 | 37 | 48 | 28 | 17 | | | | | | | | | | | | | | | | | | | | |
| 1217 | 1106 | B1.0|REF97_V4|466 | 884 | B1.0|REF99_V4|1164 | 37 | 31 | 22 | 11 | | | | | | | | | | | | | | | | | | | | |
| 1218 | 1106 | B1.0|REF97_V4|466 | 71 | B1.0|REF99_V4|1351 | 37 | 34 | 23 | 12 | | | | | | | | | | | | | | | | | | | | |
| 1219 | 1106 | B1.0|REF97_V4|466 | 789 | B1.0|REF99_V4|2172 | 37 | 38 | 25 | 13 | | | | | | | | | | | | | | | | | | | | |
| 1220 | 1106 | B1.0|REF97_V4|466 | 974 | B1.0|REF99_V4|2831 | 37 | 37 | 24 | 13 | | | | | | | | | | | | | | | | | | | | |
| 1221 | 1106 | B1.0|REF97_V4|466 | 963 | B1.0|REF99_V4|33855 | 37 | 36 | 25 | 12 | | | | | | | | | | | | | | | | | | | | |
| 1222 | 1106 | B1.0|REF97_V4|466 | 916 | B1.0|REF99_V4|3675 | 37 | 37 | 23 | 13 | | | | | | | | | | | | | | | | | | | | |
| 1223 | 1106 | B1.0|REF97_V4|466 | 1012 | B1.0|REF99_V4|597 | 37 | 34 | 23 | 12 | | | | | | | | | | | | | | | | | | | | |
| 1224 | 1106 | B1.0|REF97_V4|466 | 1106 | B1.0|REF99_V4|466 | 37 | 74 | 37 | 26 | | | | | | | | | | | | | | | | | | | | |
| 1225 | 1106 | B1.0|REF97_V4|466 | 1007 | B1.0|REF99_V4|9526 | 37 | 39 | 27 | 14 | | | | | | | | | | | | | | | | | | | | |
| 1226 | 837 | B1.0|REF97_V4|4720 | 739 | B1.0|REF99_V4|1562 | 31 | 28 | 21 | 8 | | | | | | | | | | | | | | | | | | | | |
| 1227 | 837 | B1.0|REF97_V4|4720 | 1180 | B1.0|REF99_V4|166 | 31 | 49 | 26 | 14 | | | | | | | | | | | | | | | | | | | | |
| 1228 | 837 | B1.0|REF97_V4|4720 | 656 | B1.0|REF99_V4|4191 | 31 | 38 | 24 | 11 | | | | | | | | | | | | | | | | | | | | |
| 1229 | 837 | B1.0|REF97_V4|4720 | 613 | B1.0|REF99_V4|2200 | 31 | 23 | 19 | 7 | | | | | | | | | | | | | | | | | | | | |
| 1230 | 837 | B1.0|REF97_V4|4720 | 1013 | B1.0|REF99_V4|13951 | 31 | 22 | 18 | 6 | | | | | | | | | | | | | | | | | | | | |
| 1231 | 837 | B1.0|REF97_V4|4720 | 1221 | B1.0|REF99_V4|2512 | 31 | 24 | 19 | 7 | | | | | | | | | | | | | | | | | | | | |
| 1232 | 837 | B1.0|REF97_V4|4720 | 648 | B1.0|REF99_V4|414 | 31 | 54 | 30 | 16 | | | | | | | | | | | | | | | | | | | | |
| 1233 | 837 | B1.0|REF97_V4|4720 | 665 | B1.0|REF99_V4|4446 | 31 | 25 | 22 | 8 | | | | | | | | | | | | | | | | | | | | |
| 1234 | 837 | B1.0|REF97_V4|4720 | 69 | B1.0|REF99_V4|4506 | 31 | 31 | 22 | 9 | | | | | | | | | | | | | | | | | | | | |
| 1235 | 837 | B1.0|REF97_V4|4720 | 353 | B1.0|REF99_V4|9861 | 31 | 27 | 21 | 8 | | | | | | | | | | | | | | | | | | | | |
| 1236 | 1007 | B1.0|REF97_V4|9526 | 332 | B1.0|REF99_V4|100068 | 31 | 20 | 17 | 6 | | | | | | | | | | | | | | | | | | | | |
| 1237 | 1007 | B1.0|REF97_V4|9526 | 962 | B1.0|REF99_V4|102519 | 31 | 23 | 18 | 7 | | | | | | | | | | | | | | | | | | | | |
| 1238 | 1007 | B1.0|REF97_V4|9526 | 939 | B1.0|REF99_V4|11317 | 31 | 31 | 21 | 9 | | | | | | | | | | | | | | | | | | | | |
| 1239 | 1007 | B1.0|REF97_V4|9526 | 1180 | B1.0|REF99_V4|166 | 31 | 49 | 28 | 14 | | | | | | | | | | | | | | | | | | | | |
| 1240 | 1007 | B1.0|REF97_V4|9526 | 739 | B1.0|REF99_V4|1562 | 31 | 28 | 21 | 8 | | | | | | | | | | | | | | | | | | | | |
| 1241 | 1007 | B1.0|REF97_V4|9526 | 313 | B1.0|REF99_V4|18024 | 31 | 21 | 17 | 6 | | | | | | | | | | | | | | | | | | | | |
| 1242 | 1007 | B1.0|REF97_V4|9526 | 656 | B1.0|REF99_V4|4191 | 31 | 38 | 27 | 11 | | | | | | | | | | | | | | | | | | | | |
| 1243 | 1007 | B1.0|REF97_V4|9526 | 613 | B1.0|REF99_V4|2200 | 31 | 23 | 18 | 7 | | | | | | | | | | | | | | | | | | | | |
| 1244 | 1007 | B1.0|REF97_V4|9526 | 1221 | B1.0|REF99_V4|2512 | 31 | 24 | 19 | 7 | | | | | | | | | | | | | | | | | | | | |
| 1245 | 1007 | B1.0|REF97_V4|9526 | 961 | B1.0|REF99_V4|3580 | 31 | 23 | 18 | 7 | | | | | | | | | | | | | | | | | | | | |
| 1246 | 1007 | B1.0|REF97_V4|9526 | 665 | B1.0|REF99_V4|4446 | 31 | 25 | 21 | 7 | | | | | | | | | | | | | | | | | | | | |

TABLE 14-continued

| A PAIR | B Endophyte 1 (SEQ ID) | C Endophyte 1 (OTU) | D Endophyte 2 (SEQ ID) | E Endophyte 2 (OTU) | F Bacteria - dicots | | | | G Bacteria - dicots, roots | | | | H Bacteria - dicots, seeds | | | | I Fungi - dicots | | | | J Fungi - dicots, roots | | | | K Fungi - dicots, seeds | | | |
|---|---|---|---|---|---|---|---|---|---|---|---|---|---|---|---|---|---|---|---|---|---|---|---|---|---|---|---|---|
| | | | | | N1 | N2 | OC | EC | N1 | N2 | OC | EC | N1 | N2 | OC | EC | N1 | N2 | OC | EC | N1 | N2 | OC | EC | N1 | N2 | OC | EC |
| 1247 | 1007 | B1.0IREF97_V49526 | 69 | B1.0IREF99_V41506 | 31 | 31 | 23 | 9 | | | | | | | | | | | | | | | | | | | | |
| 1248 | 1007 | B1.0IREF97_V49526 | 734 | B1.0IREF99_V41558 | 31 | 31 | 22 | 9 | | | | | | | | | | | | | | | | | | | | |
| 1249 | 1007 | B1.0IREF97_V49526 | 853 | B1.0IREF99_V415965 | 31 | 22 | 18 | 6 | | | | | | | | | | | | | | | | | | | | |
| 1250 | 1007 | B1.0IREF97_V49526 | 319 | B1.0IREF99_V470731 | 31 | 25 | 20 | 7 | | | | | | | | | | | | | | | | | | | | |
| 1251 | 1007 | B1.0IREF97_V49526 | 915 | B1.0IREF99_V4884 | 31 | 33 | 26 | 10 | | | | | | | | | | | | | | | | | | | | |
| 1252 | 1007 | B1.0IREF97_V49526 | 968 | B1.0IREF99_V4972 | 31 | 19 | 17 | 6 | | | | | | | | | | | | | | | | | | | | |
| 1253 | 1007 | B1.0IREF97_V49526 | 353 | B1.0IREF99_V49861 | 31 | 27 | 22 | 8 | | | | | | | | | | | | | | | | | | | | |
| 1254 | 1007 | B1.0IREF97_V49526 | 653 | B1.0IREF99_V4995 | 31 | 26 | 19 | 8 | | | | | | | | | | | | | | | | | | | | |
| 1255 | 332 | B1.0IREF99_V410068 | 137 | B1.0IREF99_V4111 | 20 | 48 | 20 | 9 | | | | | | | | | | | | | | | | | | | | |
| 1256 | 332 | B1.0IREF99_V410068 | 884 | B1.0IREF99_V411164 | 20 | 31 | 18 | 6 | | | | | | | | | | | | | | | | | | | | |
| 1257 | 332 | B1.0IREF99_V410068 | 959 | B1.0IREF99_V4126 | 20 | 32 | 17 | 6 | | | | | | | | | | | | | | | | | | | | |
| 1258 | 332 | B1.0IREF99_V410068 | 71 | B1.0IREF99_V411351 | 20 | 34 | 19 | 6 | | | | | | | | | | | | | | | | | | | | |
| 1259 | 332 | B1.0IREF99_V410068 | 739 | B1.0IREF99_V411562 | 20 | 28 | 16 | 6 | | | | | | | | | | | | | | | | | | | | |
| 1260 | 332 | B1.0IREF99_V410068 | 1011 | B1.0IREF99_V412104 | 20 | 32 | 17 | 6 | | | | | | | | | | | | | | | | | | | | |
| 1261 | 332 | B1.0IREF99_V410068 | 789 | B1.0IREF99_V412172 | 20 | 38 | 19 | 7 | | | | | | | | | | | | | | | | | | | | |
| 1262 | 332 | B1.0IREF99_V410068 | 943 | B1.0IREF99_V426030 | 20 | 30 | 18 | 6 | | | | | | | | | | | | | | | | | | | | |
| 1263 | 332 | B1.0IREF99_V410068 | 974 | B1.0IREF99_V412831 | 20 | 37 | 20 | 7 | | | | | | | | | | | | | | | | | | | | |
| 1264 | 332 | B1.0IREF99_V410068 | 615 | B1.0IREF99_V413374 | 20 | 32 | 17 | 6 | | | | | | | | | | | | | | | | | | | | |
| 1265 | 332 | B1.0IREF99_V410068 | 916 | B1.0IREF99_V413675 | 20 | 37 | 20 | 7 | | | | | | | | | | | | | | | | | | | | |
| 1266 | 332 | B1.0IREF99_V410068 | 69 | B1.0IREF99_V41506 | 20 | 31 | 17 | 6 | | | | | | | | | | | | | | | | | | | | |
| 1267 | 332 | B1.0IREF99_V410068 | 1012 | B1.0IREF99_V4597 | 20 | 34 | 19 | 6 | | | | | | | | | | | | | | | | | | | | |
| 1268 | 332 | B1.0IREF99_V410068 | 837 | B1.0IREF99_V41720 | 20 | 47 | 20 | 9 | | | | | | | | | | | | | | | | | | | | |
| 1269 | 332 | B1.0IREF99_V410068 | 713 | B1.0IREF99_V41754 | 20 | 37 | 18 | 7 | | | | | | | | | | | | | | | | | | | | |
| 1270 | 332 | B1.0IREF99_V410068 | 915 | B1.0IREF99_V4884 | 20 | 33 | 17 | 6 | | | | | | | | | | | | | | | | | | | | |
| 1271 | 332 | B1.0IREF99_V410068 | 1007 | B1.0IREF99_V49526 | 20 | 39 | 18 | 7 | | | | | | | | | | | | | | | | | | | | |
| 1272 | 962 | B1.0IREF99_V4102519 | 137 | B1.0IREF99_V4111 | 23 | 48 | 23 | 10 | | | | | | | | | | | | | | | | | | | | |
| 1273 | 962 | B1.0IREF99_V4102519 | 884 | B1.0IREF99_V411164 | 23 | 31 | 20 | 7 | | | | | | | | | | | | | | | | | | | | |
| 1274 | 962 | B1.0IREF99_V4102519 | 959 | B1.0IREF99_V4126 | 23 | 32 | 22 | 7 | | | | | | | | | | | | | | | | | | | | |
| 1275 | 962 | B1.0IREF99_V4102519 | 886 | B1.0IREF99_V41287 | 23 | 26 | 16 | 5 | | | | | | | | | | | | | | | | | | | | |
| 1276 | 962 | B1.0IREF99_V4102519 | 939 | B1.0IREF99_V411317 | 23 | 31 | 19 | 7 | | | | | | | | | | | | | | | | | | | | |
| 1277 | 962 | B1.0IREF99_V4102519 | 648 | B1.0IREF99_V414 | 23 | 54 | 23 | 12 | | | | | | | | | | | | | | | | | | | | |
| 1278 | 962 | B1.0IREF99_V4102519 | 739 | B1.0IREF99_V411562 | 23 | 28 | 18 | 6 | | | | | | | | | | | | | | | | | | | | |
| 1279 | 962 | B1.0IREF99_V4102519 | 116 | B1.0IREF99_V411567 | 23 | 29 | 19 | 6 | | | | | | | | | | | | | | | | | | | | |
| 1280 | 962 | B1.0IREF99_V4102519 | 656 | B1.0IREF99_V41191 | 23 | 38 | 19 | 8 | | | | | | | | | | | | | | | | | | | | |
| 1281 | 962 | B1.0IREF99_V4102519 | 1011 | B1.0IREF99_V412104 | 23 | 32 | 22 | 7 | | | | | | | | | | | | | | | | | | | | |
| 1282 | 962 | B1.0IREF99_V4102519 | 789 | B1.0IREF99_V412172 | 23 | 38 | 23 | 8 | | | | | | | | | | | | | | | | | | | | |
| 1283 | 962 | B1.0IREF99_V4102519 | 810 | B1.0IREF99_V41250 | 23 | 26 | 18 | 6 | | | | | | | | | | | | | | | | | | | | |
| 1284 | 962 | B1.0IREF99_V4102519 | 1221 | B1.0IREF99_V412512 | 23 | 24 | 19 | 5 | | | | | | | | | | | | | | | | | | | | |
| 1285 | 962 | B1.0IREF99_V4102519 | 943 | B1.0IREF99_V426030 | 23 | 30 | 20 | 6 | | | | | | | | | | | | | | | | | | | | |
| 1286 | 962 | B1.0IREF99_V4102519 | 615 | B1.0IREF99_V413374 | 23 | 32 | 20 | 7 | | | | | | | | | | | | | | | | | | | | |
| 1287 | 962 | B1.0IREF99_V4102519 | 963 | B1.0IREF99_V433855 | 23 | 36 | 20 | 8 | | | | | | | | | | | | | | | | | | | | |
| 1288 | 962 | B1.0IREF99_V4102519 | 961 | B1.0IREF99_V413580 | 23 | 29 | 17 | 5 | | | | | | | | | | | | | | | | | | | | |
| 1289 | 962 | B1.0IREF99_V4102519 | 945 | B1.0IREF99_V41442 | 23 | 26 | 18 | 6 | | | | | | | | | | | | | | | | | | | | |
| 1290 | 962 | B1.0IREF99_V4102519 | 69 | B1.0IREF99_V41506 | 23 | 31 | 19 | 7 | | | | | | | | | | | | | | | | | | | | |
| 1291 | 962 | B1.0IREF99_V4102519 | 853 | B1.0IREF99_V415965 | 23 | 22 | 16 | 5 | | | | | | | | | | | | | | | | | | | | |
| 1292 | 962 | B1.0IREF99_V4102519 | 1012 | B1.0IREF99_V4597 | 23 | 34 | 21 | 7 | | | | | | | | | | | | | | | | | | | | |

TABLE 14-continued

| A PAIR | B Endophyte 1 (SEQ ID) | C Endophyte 1 (OTU) | D Endophyte 2 (SEQ ID) | E Endophyte 2 (OTU) | F Bacteria - dicots | | | | G Bacteria - dicots, roots | | | | H Bacteria - dicots, seeds | | | | I Fungi - dicots | | | | J Fungi - dicots, roots | | | | K Fungi - dicots, seeds | | | |
|---|---|---|---|---|---|---|---|---|---|---|---|---|---|---|---|---|---|---|---|---|---|---|---|---|---|---|---|---|
| | | | | | N1 | N2 | OC | EC | N1 | N2 | OC | EC | N1 | N2 | OC | EC | N1 | N2 | OC | EC | N1 | N2 | OC | EC | N1 | N2 | OC | EC |
| 1293 | 962 | B1.0iREF99_V4|102519 | 837 | B1.0iREF99_V4|720 | 23 | 47 | 23 | 10 | | | | | | | | | | | | | | | | | | | | |
| 1294 | 962 | B1.0iREF99_V4|102519 | 713 | B1.0iREF99_V4|754 | 23 | 37 | 22 | 8 | | | | | | | | | | | | | | | | | | | | |
| 1295 | 962 | B1.0iREF99_V4|102519 | 915 | B1.0iREF99_V4|884 | 23 | 33 | 21 | 7 | | | | | | | | | | | | | | | | | | | | |
| 1296 | 962 | B1.0iREF99_V4|102519 | 1007 | B1.0iREF99_V4|49526 | 23 | 39 | 21 | 8 | | | | | | | | | | | | | | | | | | | | |
| 1297 | 962 | B1.0iREF99_V4|102519 | 353 | B1.0iREF99_V4|49861 | 23 | 27 | 17 | 6 | | | | | | | | | | | | | | | | | | | | |
| 1298 | 962 | B1.0iREF99_V4|102519 | 653 | B1.0iREF99_V4|995 | 23 | 26 | 18 | 6 | | | | | | | | | | | | | | | | | | | | |
| 1299 | 962 | B1.0iREF99_V4|102519 | 892 | B1.0iREF99_V4|1177 | 48 | 25 | 24 | 11 | | | | | | | | | | | | | | | | | | | | |
| 1300 | 137 | B1.0iREF99_V4|411 | 939 | B1.0iREF99_V4|1317 | 48 | 31 | 27 | 14 | | | | | | | | | | | | | | | | | | | | |
| 1301 | 137 | B1.0iREF99_V4|411 | 1013 | B1.0iREF99_V4|13951 | 48 | 22 | 22 | 10 | | | | | | | | | | | | | | | | | | | | |
| 1302 | 137 | B1.0iREF99_V4|411 | 739 | B1.0iREF99_V4|1562 | 48 | 28 | 27 | 13 | | | | | | | | | | | | | | | | | | | | |
| 1303 | 137 | B1.0iREF99_V4|411 | 59 | B1.0iREF99_V4|171149 | 48 | 20 | 20 | 9 | | | | | | | | | | | | | | | | | | | | |
| 1304 | 137 | B1.0iREF99_V4|411 | 313 | B1.0iREF99_V4|18024 | 48 | 21 | 21 | 9 | | | | | | | | | | | | | | | | | | | | |
| 1305 | 137 | B1.0iREF99_V4|411 | 681 | B1.0iREF99_V4|234 | 48 | 41 | 30 | 18 | | | | | | | | | | | | | | | | | | | | |
| 1306 | 137 | B1.0iREF99_V4|411 | 683 | B1.0iREF99_V4|2385 | 48 | 20 | 20 | 9 | | | | | | | | | | | | | | | | | | | | |
| 1307 | 137 | B1.0iREF99_V4|411 | 1221 | B1.0iREF99_V4|2512 | 48 | 24 | 24 | 11 | | | | | | | | | | | | | | | | | | | | |
| 1308 | 137 | B1.0iREF99_V4|411 | 961 | B1.0iREF99_V4|3580 | 48 | 23 | 23 | 10 | | | | | | | | | | | | | | | | | | | | |
| 1309 | 137 | B1.0iREF99_V4|411 | 665 | B1.0iREF99_V4|4446 | 48 | 25 | 25 | 11 | | | | | | | | | | | | | | | | | | | | |
| 1310 | 137 | B1.0iREF99_V4|411 | 853 | B1.0iREF99_V4|5965 | 48 | 22 | 22 | 10 | | | | | | | | | | | | | | | | | | | | |
| 1311 | 137 | B1.0iREF99_V4|411 | 1106 | B1.0iREF99_V4|166 | 48 | 74 | 44 | 33 | | | | | | | | | | | | | | | | | | | | |
| 1312 | 137 | B1.0iREF99_V4|411 | 353 | B1.0iREF99_V4|49861 | 48 | 27 | 26 | 12 | | | | | | | | | | | | | | | | | | | | |
| 1313 | 137 | B1.0iREF99_V4|411 | 653 | B1.0iREF99_V4|995 | 48 | 26 | 24 | 12 | | | | | | | | | | | | | | | | | | | | |
| 1314 | 884 | B1.0iREF99_V4|1164 | 839 | B1.0iREF99_V4|1186 | 31 | 20 | 18 | 6 | | | | | | | | | | | | | | | | | | | | |
| 1315 | 884 | B1.0iREF99_V4|1164 | 1013 | B1.0iREF99_V4|13951 | 31 | 22 | 18 | 6 | | | | | | | | | | | | | | | | | | | | |
| 1316 | 884 | B1.0iREF99_V4|1164 | 648 | B1.0iREF99_V4|414 | 31 | 54 | 31 | 16 | | | | | | | | | | | | | | | | | | | | |
| 1317 | 884 | B1.0iREF99_V4|1164 | 739 | B1.0iREF99_V4|1562 | 31 | 28 | 23 | 8 | | | | | | | | | | | | | | | | | | | | |
| 1318 | 884 | B1.0iREF99_V4|1164 | 1180 | B1.0iREF99_V4|166 | 31 | 49 | 28 | 14 | | | | | | | | | | | | | | | | | | | | |
| 1319 | 884 | B1.0iREF99_V4|1164 | 59 | B1.0iREF99_V4|171149 | 31 | 20 | 17 | 6 | | | | | | | | | | | | | | | | | | | | |
| 1320 | 884 | B1.0iREF99_V4|1164 | 313 | B1.0iREF99_V4|18024 | 31 | 21 | 19 | 6 | | | | | | | | | | | | | | | | | | | | |
| 1321 | 884 | B1.0iREF99_V4|1164 | 656 | B1.0iREF99_V4|4191 | 31 | 38 | 28 | 11 | | | | | | | | | | | | | | | | | | | | |
| 1322 | 884 | B1.0iREF99_V4|1164 | 613 | B1.0iREF99_V4|42200 | 31 | 23 | 20 | 7 | | | | | | | | | | | | | | | | | | | | |
| 1323 | 884 | B1.0iREF99_V4|1164 | 887 | B1.0iREF99_V4|42238 | 31 | 19 | 17 | 6 | | | | | | | | | | | | | | | | | | | | |
| 1324 | 884 | B1.0iREF99_V4|1164 | 961 | B1.0iREF99_V4|43580 | 31 | 23 | 19 | 7 | | | | | | | | | | | | | | | | | | | | |
| 1325 | 884 | B1.0iREF99_V4|1164 | 665 | B1.0iREF99_V4|4446 | 31 | 28 | 23 | 7 | | | | | | | | | | | | | | | | | | | | |
| 1326 | 884 | B1.0iREF99_V4|1164 | 69 | B1.0iREF99_V4|4506 | 31 | 49 | 28 | 9 | | | | | | | | | | | | | | | | | | | | |
| 1327 | 884 | B1.0iREF99_V4|1164 | 60 | B1.0iREF99_V4|4514 | 31 | 20 | 17 | 6 | | | | | | | | | | | | | | | | | | | | |
| 1328 | 884 | B1.0iREF99_V4|1164 | 734 | B1.0iREF99_V4|4558 | 31 | 22 | 19 | 9 | | | | | | | | | | | | | | | | | | | | |
| 1329 | 884 | B1.0iREF99_V4|1164 | 853 | B1.0iREF99_V4|45965 | 31 | 31 | 21 | 9 | | | | | | | | | | | | | | | | | | | | |
| 1330 | 884 | B1.0iREF99_V4|1164 | 915 | B1.0iREF99_V4|4884 | 31 | 33 | 29 | 10 | | | | | | | | | | | | | | | | | | | | |
| 1331 | 884 | B1.0iREF99_V4|1164 | 968 | B1.0iREF99_V4|49972 | 31 | 19 | 18 | 6 | | | | | | | | | | | | | | | | | | | | |
| 1332 | 884 | B1.0iREF99_V4|1164 | 353 | B1.0iREF99_V4|49861 | 31 | 22 | 19 | 8 | | | | | | | | | | | | | | | | | | | | |
| 1333 | 884 | B1.0iREF99_V4|1164 | 653 | B1.0iREF99_V4|4995 | 31 | 27 | 22 | 8 | | | | | | | | | | | | | | | | | | | | |
| 1334 | 892 | B1.0iREF99_V4|1177 | 939 | B1.0iREF99_V4|1317 | 31 | 31 | 19 | 7 | | | | | | | | | | | | | | | | | | | | |
| 1335 | 892 | B1.0iREF99_V4|1177 | 71 | B1.0iREF99_V4|1351 | 25 | 34 | 23 | 8 | | | | | | | | | | | | | | | | | | | | |
| 1336 | 892 | B1.0iREF99_V4|1177 | 648 | B1.0iREF99_V4|414 | 25 | 54 | 25 | 13 | | | | | | | | | | | | | | | | | | | | |
| 1337 | 892 | B1.0iREF99_V4|1177 | 739 | B1.0iREF99_V4|1562 | 25 | 28 | 18 | 7 | | | | | | | | | | | | | | | | | | | | |
| 1338 | 892 | B1.0iREF99_V4|1177 | 116 | B1.0iREF99_V4|1567 | 25 | 29 | 20 | 7 | | | | | | | | | | | | | | | | | | | | |

TABLE 14-continued

| A PAIR | B Endophyte 1 (SEQ ID) | C Endophyte 1 (OTU) | D Endophyte 2 (SEQ ID) | E Endophyte 2 (OTU) | F Bacteria - dicots | | | | G Bacteria - dicots, roots | | | | H Bacteria - dicots, seeds | | | | I Fungi - dicots | | | | J Fungi - dicots, roots | | | | K Fungi - dicots, seeds | | | |
|---|---|---|---|---|---|---|---|---|---|---|---|---|---|---|---|---|---|---|---|---|---|---|---|---|---|---|---|---|
| | | | | | N1 | N2 | OC | EC | N1 | N2 | OC | EC | N1 | N2 | OC | EC | N1 | N2 | OC | EC | N1 | N2 | OC | EC | N1 | N2 | OC | EC |
| 1339 | 892 | B1.0|REF99_V4|1177 | 1180 | B1.0|REF99_V4|166 | 25 | 49 | 23 | 11 | | | | | | | | | | | | | | | | | | | | |
| 1340 | 892 | B1.0|REF99_V4|1177 | 656 | B1.0|REF99_V4|191 | 25 | 38 | 21 | 9 | | | | | | | | | | | | | | | | | | | | |
| 1341 | 892 | B1.0|REF99_V4|1177 | 1221 | B1.0|REF99_V4|2512 | 25 | 24 | 17 | 6 | | | | | | | | | | | | | | | | | | | | |
| 1342 | 892 | B1.0|REF99_V4|1177 | 615 | B1.0|REF99_V4|3374 | 25 | 32 | 22 | 8 | | | | | | | | | | | | | | | | | | | | |
| 1343 | 892 | B1.0|REF99_V4|1177 | 963 | B1.0|REF99_V4|33855 | 25 | 36 | 20 | 8 | | | | | | | | | | | | | | | | | | | | |
| 1344 | 892 | B1.0|REF99_V4|1177 | 945 | B1.0|REF99_V4|442 | 25 | 26 | 17 | 6 | | | | | | | | | | | | | | | | | | | | |
| 1345 | 892 | B1.0|REF99_V4|1177 | 665 | B1.0|REF99_V4|446 | 25 | 25 | 19 | 6 | | | | | | | | | | | | | | | | | | | | |
| 1346 | 892 | B1.0|REF99_V4|1177 | 69 | B1.0|REF99_V4|506 | 25 | 31 | 20 | 7 | | | | | | | | | | | | | | | | | | | | |
| 1347 | 892 | B1.0|REF99_V4|1177 | 1012 | B1.0|REF99_V4|597 | 25 | 34 | 22 | 8 | | | | | | | | | | | | | | | | | | | | |
| 1348 | 892 | B1.0|REF99_V4|1177 | 319 | B1.0|REF99_V4|70731 | 25 | 25 | 19 | 6 | | | | | | | | | | | | | | | | | | | | |
| 1349 | 892 | B1.0|REF99_V4|1177 | 837 | B1.0|REF99_V4|720 | 25 | 47 | 24 | 11 | | | | | | | | | | | | | | | | | | | | |
| 1350 | 892 | B1.0|REF99_V4|1177 | 713 | B1.0|REF99_V4|754 | 25 | 37 | 23 | 9 | | | | | | | | | | | | | | | | | | | | |
| 1351 | 892 | B1.0|REF99_V4|1177 | 915 | B1.0|REF99_V4|884 | 25 | 33 | 21 | 8 | | | | | | | | | | | | | | | | | | | | |
| 1352 | 892 | B1.0|REF99_V4|1177 | 353 | B1.0|REF99_V4|9861 | 25 | 27 | 18 | 6 | | | | | | | | | | | | | | | | | | | | |
| 1353 | 54 | B1.0|REF99_V4|118524 | 915 | B1.0|REF99_V4|884 | 16 | 33 | 16 | 5 | | | | | | | | | | | | | | | | | | | | |
| 1354 | 839 | B1.0|REF99_V4|1186 | 1011 | B1.0|REF99_V4|2104 | 20 | 32 | 17 | 6 | | | | | | | | | | | | | | | | | | | | |
| 1355 | 839 | B1.0|REF99_V4|1186 | 789 | B1.0|REF99_V4|2172 | 20 | 38 | 19 | 7 | | | | | | | | | | | | | | | | | | | | |
| 1356 | 839 | B1.0|REF99_V4|1186 | 943 | B1.0|REF99_V4|26030 | 20 | 30 | 17 | 6 | | | | | | | | | | | | | | | | | | | | |
| 1357 | 839 | B1.0|REF99_V4|1186 | 615 | B1.0|REF99_V4|3374 | 20 | 32 | 18 | 6 | | | | | | | | | | | | | | | | | | | | |
| 1358 | 839 | B1.0|REF99_V4|1186 | 916 | B1.0|REF99_V4|3675 | 20 | 37 | 19 | 7 | | | | | | | | | | | | | | | | | | | | |
| 1359 | 839 | B1.0|REF99_V4|1186 | 945 | B1.0|REF99_V4|442 | 20 | 26 | 16 | 5 | | | | | | | | | | | | | | | | | | | | |
| 1360 | 839 | B1.0|REF99_V4|1186 | 915 | B1.0|REF99_V4|884 | 20 | 33 | 17 | 6 | | | | | | | | | | | | | | | | | | | | |
| 1361 | 839 | B1.0|REF99_V4|1186 | 1007 | B1.0|REF99_V4|9526 | 20 | 39 | 18 | 7 | | | | | | | | | | | | | | | | | | | | |
| 1362 | 959 | B1.0|REF99_V4|126 | 739 | B1.0|REF99_V4|1562 | 32 | 28 | 22 | 8 | | | | | | | | | | | | | | | | | | | | |
| 1363 | 959 | B1.0|REF99_V4|126 | 887 | B1.0|REF99_V4|2238 | 32 | 19 | 17 | 6 | | | | | | | | | | | | | | | | | | | | |
| 1364 | 959 | B1.0|REF99_V4|126 | 1221 | B1.0|REF99_V4|2512 | 32 | 24 | 21 | 7 | | | | | | | | | | | | | | | | | | | | |
| 1365 | 959 | B1.0|REF99_V4|126 | 665 | B1.0|REF99_V4|446 | 32 | 25 | 23 | 8 | | | | | | | | | | | | | | | | | | | | |
| 1366 | 959 | B1.0|REF99_V4|126 | 853 | B1.0|REF99_V4|5965 | 32 | 22 | 21 | 7 | | | | | | | | | | | | | | | | | | | | |
| 1367 | 959 | B1.0|REF99_V4|126 | 1177 | B1.0|REF99_V4|64 | 32 | 40 | 23 | 12 | | | | | | | | | | | | | | | | | | | | |
| 1368 | 959 | B1.0|REF99_V4|126 | 353 | B1.0|REF99_V4|9861 | 32 | 27 | 21 | 8 | | | | | | | | | | | | | | | | | | | | |
| 1369 | 959 | B1.0|REF99_V4|1287 | 653 | B1.0|REF99_V4|995 | 32 | 26 | 23 | 8 | | | | | | | | | | | | | | | | | | | | |
| 1370 | 959 | B1.0|REF99_V4|1287 | 648 | B1.0|REF99_V4|414 | 22 | 54 | 22 | 11 | | | | | | | | | | | | | | | | | | | | |
| 1371 | 886 | B1.0|REF99_V4|1287 | 116 | B1.0|REF99_V4|41567 | 22 | 29 | 17 | 6 | | | | | | | | | | | | | | | | | | | | |
| 1372 | 886 | B1.0|REF99_V4|1287 | 613 | B1.0|REF99_V4|42200 | 22 | 23 | 16 | 5 | | | | | | | | | | | | | | | | | | | | |
| 1373 | 886 | B1.0|REF99_V4|1287 | 963 | B1.0|REF99_V4|33855 | 22 | 36 | 19 | 7 | | | | | | | | | | | | | | | | | | | | |
| 1374 | 886 | B1.0|REF99_V4|1287 | 915 | B1.0|REF99_V4|884 | 22 | 33 | 20 | 7 | | | | | | | | | | | | | | | | | | | | |
| 1375 | 886 | B1.0|REF99_V4|1287 | 648 | B1.0|REF99_V4|414 | 31 | 54 | 31 | 16 | | | | | | | | | | | | | | | | | | | | |
| 1376 | 939 | B1.0|REF99_V4|1317 | 739 | B1.0|REF99_V4|1562 | 31 | 28 | 22 | 8 | | | | | | | | | | | | | | | | | | | | |
| 1377 | 939 | B1.0|REF99_V4|1317 | 1180 | B1.0|REF99_V4|166 | 31 | 49 | 27 | 14 | | | | | | | | | | | | | | | | | | | | |
| 1378 | 939 | B1.0|REF99_V4|1317 | 313 | B1.0|REF99_V4|418024 | 31 | 21 | 18 | 6 | | | | | | | | | | | | | | | | | | | | |
| 1379 | 939 | B1.0|REF99_V4|1317 | 656 | B1.0|REF99_V4|4191 | 31 | 38 | 25 | 11 | | | | | | | | | | | | | | | | | | | | |
| 1380 | 939 | B1.0|REF99_V4|1317 | 1011 | B1.0|REF99_V4|42104 | 31 | 32 | 24 | 9 | | | | | | | | | | | | | | | | | | | | |
| 1381 | 939 | B1.0|REF99_V4|1317 | 131 | B1.0|REF99_V4|4251 | 31 | 54 | 31 | 16 | | | | | | | | | | | | | | | | | | | | |
| 1382 | 939 | B1.0|REF99_V4|1317 | 1221 | B1.0|REF99_V4|42512 | 31 | 24 | 20 | 7 | | | | | | | | | | | | | | | | | | | | |
| 1383 | 939 | B1.0|REF99_V4|1317 | 943 | B1.0|REF99_V4|26030 | 31 | 30 | 21 | 9 | | | | | | | | | | | | | | | | | | | | |
| 1384 | 939 | B1.0|REF99_V4|1317 | 963 | B1.0|REF99_V4|33855 | 31 | 36 | 24 | 10 | | | | | | | | | | | | | | | | | | | | |

TABLE 14-continued

| A PAIR | B Endophyte 1 (SEQ ID) | C Endophyte 1 (OTU) | D Endophyte 2 (SEQ ID) | E Endophyte 2 (OTU) | F Bacteria - dicots | | | | G Bacteria - dicots, roots | | | | H Bacteria - dicots, seeds | | | | I Fungi - dicots | | | | J Fungi - dicots, roots | | | | K Fungi - dicots, seeds | | | |
|---|---|---|---|---|---|---|---|---|---|---|---|---|---|---|---|---|---|---|---|---|---|---|---|---|---|---|---|---|
| | | | | | N1 | N2 | OC | EC | N1 | N2 | OC | EC | N1 | N2 | OC | EC | N1 | N2 | OC | EC | N1 | N2 | OC | EC | N1 | N2 | OC | EC |
| 1385 | 939 | B1.0|REF99_V4|1317 | 665 | B1.0|REF99_V4|446 | 31 | 25 | 20 | 7 | | | | | | | | | | | | | | | | | | | | |
| 1386 | 939 | B1.0|REF99_V4|1317 | 69 | B1.0|REF99_V4|4506 | 31 | 31 | 21 | 9 | | | | | | | | | | | | | | | | | | | | |
| 1387 | 939 | B1.0|REF99_V4|1317 | 621 | B1.0|REF99_V4|4569 | 31 | 18 | 16 | 5 | | | | | | | | | | | | | | | | | | | | |
| 1388 | 939 | B1.0|REF99_V4|1317 | 319 | B1.0|REF99_V4|470731 | 31 | 25 | 19 | 7 | | | | | | | | | | | | | | | | | | | | |
| 1389 | 939 | B1.0|REF99_V4|1317 | 713 | B1.0|REF99_V4|4754 | 31 | 37 | 25 | 11 | | | | | | | | | | | | | | | | | | | | |
| 1390 | 939 | B1.0|REF99_V4|1317 | 915 | B1.0|REF99_V4|4884 | 31 | 33 | 24 | 10 | | | | | | | | | | | | | | | | | | | | |
| 1391 | 939 | B1.0|REF99_V4|1317 | 1007 | B1.0|REF99_V4|49526 | 31 | 39 | 25 | 11 | | | | | | | | | | | | | | | | | | | | |
| 1392 | 939 | B1.0|REF99_V4|1317 | 353 | B1.0|REF99_V4|49861 | 31 | 27 | 22 | 8 | | | | | | | | | | | | | | | | | | | | |
| 1393 | 939 | B1.0|REF99_V4|1317 | 653 | B1.0|REF99_V4|4995 | 31 | 26 | 21 | 7 | | | | | | | | | | | | | | | | | | | | |
| 1394 | 71 | B1.0|REF99_V4|1351 | 1013 | B1.0|REF99_V4|413951 | 34 | 22 | 21 | 9 | | | | | | | | | | | | | | | | | | | | |
| 1395 | 71 | B1.0|REF99_V4|1351 | 739 | B1.0|REF99_V4|41562 | 34 | 28 | 24 | 9 | | | | | | | | | | | | | | | | | | | | |
| 1396 | 71 | B1.0|REF99_V4|1351 | 1171 | B1.0|REF99_V4|41639 | 34 | 16 | 16 | 5 | | | | | | | | | | | | | | | | | | | | |
| 1397 | 71 | B1.0|REF99_V4|1351 | 1180 | B1.0|REF99_V4|4166 | 34 | 49 | 30 | 16 | | | | | | | | | | | | | | | | | | | | |
| 1398 | 71 | B1.0|REF99_V4|1351 | 889 | B1.0|REF99_V4|4185 | 34 | 28 | 20 | 9 | | | | | | | | | | | | | | | | | | | | |
| 1399 | 71 | B1.0|REF99_V4|1351 | 887 | B1.0|REF99_V4|42238 | 34 | 19 | 18 | 6 | | | | | | | | | | | | | | | | | | | | |
| 1400 | 71 | B1.0|REF99_V4|1351 | 1221 | B1.0|REF99_V4|42512 | 34 | 24 | 22 | 8 | | | | | | | | | | | | | | | | | | | | |
| 1401 | 71 | B1.0|REF99_V4|1351 | 665 | B1.0|REF99_V4|4446 | 34 | 25 | 23 | 8 | | | | | | | | | | | | | | | | | | | | |
| 1402 | 71 | B1.0|REF99_V4|1351 | 60 | B1.0|REF99_V4|4514 | 34 | 22 | 20 | 7 | | | | | | | | | | | | | | | | | | | | |
| 1403 | 71 | B1.0|REF99_V4|1351 | 853 | B1.0|REF99_V4|415965 | 34 | 22 | 20 | 7 | | | | | | | | | | | | | | | | | | | | |
| 1404 | 71 | B1.0|REF99_V4|1351 | 1177 | B1.0|REF99_V4|464 | 34 | 40 | 25 | 13 | | | | | | | | | | | | | | | | | | | | |
| 1405 | 71 | B1.0|REF99_V4|1351 | 968 | B1.0|REF99_V4|4972 | 34 | 19 | 17 | 6 | | | | | | | | | | | | | | | | | | | | |
| 1406 | 71 | B1.0|REF99_V4|1351 | 353 | B1.0|REF99_V4|49861 | 34 | 27 | 24 | 9 | | | | | | | | | | | | | | | | | | | | |
| 1407 | 71 | B1.0|REF99_V4|1351 | 653 | B1.0|REF99_V4|4995 | 34 | 26 | 23 | 8 | | | | | | | | | | | | | | | | | | | | |
| 1408 | 1013 | B1.0|REF99_V4|413951 | 648 | B1.0|REF99_V4|4414 | 22 | 54 | 22 | 11 | | | | | | | | | | | | | | | | | | | | |
| 1409 | 1013 | B1.0|REF99_V4|413951 | 116 | B1.0|REF99_V4|41567 | 22 | 29 | 17 | 6 | | | | | | | | | | | | | | | | | | | | |
| 1410 | 1013 | B1.0|REF99_V4|413951 | 656 | B1.0|REF99_V4|4191 | 22 | 38 | 19 | 8 | | | | | | | | | | | | | | | | | | | | |
| 1411 | 1013 | B1.0|REF99_V4|413951 | 1011 | B1.0|REF99_V4|42104 | 22 | 32 | 18 | 7 | | | | | | | | | | | | | | | | | | | | |
| 1412 | 1013 | B1.0|REF99_V4|413951 | 613 | B1.0|REF99_V4|42200 | 22 | 23 | 16 | 5 | | | | | | | | | | | | | | | | | | | | |
| 1413 | 1013 | B1.0|REF99_V4|413951 | 131 | B1.0|REF99_V4|4251 | 22 | 30 | 18 | 6 | | | | | | | | | | | | | | | | | | | | |
| 1414 | 1013 | B1.0|REF99_V4|413951 | 943 | B1.0|REF99_V4|426030 | 22 | 30 | 17 | 6 | | | | | | | | | | | | | | | | | | | | |
| 1415 | 1013 | B1.0|REF99_V4|413951 | 615 | B1.0|REF99_V4|43374 | 22 | 32 | 19 | 7 | | | | | | | | | | | | | | | | | | | | |
| 1416 | 1013 | B1.0|REF99_V4|413951 | 963 | B1.0|REF99_V4|433855 | 22 | 36 | 21 | 7 | | | | | | | | | | | | | | | | | | | | |
| 1417 | 1013 | B1.0|REF99_V4|413951 | 945 | B1.0|REF99_V4|4442 | 22 | 26 | 17 | 5 | | | | | | | | | | | | | | | | | | | | |
| 1418 | 1013 | B1.0|REF99_V4|413951 | 1012 | B1.0|REF99_V4|4597 | 22 | 34 | 19 | 7 | | | | | | | | | | | | | | | | | | | | |
| 1419 | 1013 | B1.0|REF99_V4|413951 | 319 | B1.0|REF99_V4|470731 | 22 | 25 | 16 | 5 | | | | | | | | | | | | | | | | | | | | |
| 1420 | 1013 | B1.0|REF99_V4|413951 | 837 | B1.0|REF99_V4|4720 | 22 | 47 | 22 | 10 | | | | | | | | | | | | | | | | | | | | |
| 1421 | 1013 | B1.0|REF99_V4|413951 | 713 | B1.0|REF99_V4|4754 | 22 | 29 | 21 | 8 | | | | | | | | | | | | | | | | | | | | |
| 1422 | 1013 | B1.0|REF99_V4|413951 | 915 | B1.0|REF99_V4|4884 | 22 | 33 | 21 | 7 | | | | | | | | | | | | | | | | | | | | |
| 1423 | 1013 | B1.0|REF99_V4|413951 | 1007 | B1.0|REF99_V4|49526 | 22 | 39 | 20 | 8 | | | | | | | | | | | | | | | | | | | | |
| 1424 | 648 | B1.0|REF99_V4|414 | 260 | B1.0|REF99_V4|414662 | 54 | 39 | 31 | 20 | | | | | | | | | | | | | | | | | | | | |
| 1425 | 648 | B1.0|REF99_V4|414 | 739 | B1.0|REF99_V4|41562 | 54 | 28 | 26 | 14 | | | | | | | | | | | | | | | | | | | | |
| 1426 | 648 | B1.0|REF99_V4|414 | 116 | B1.0|REF99_V4|41567 | 54 | 29 | 27 | 15 | | | | | | | | | | | | | | | | | | | | |
| 1427 | 648 | B1.0|REF99_V4|414 | 889 | B1.0|REF99_V4|4185 | 54 | 28 | 26 | 14 | | | | | | | | | | | | | | | | | | | | |
| 1428 | 648 | B1.0|REF99_V4|414 | 656 | B1.0|REF99_V4|4191 | 54 | 38 | 36 | 19 | | | | | | | | | | | | | | | | | | | | |
| 1429 | 648 | B1.0|REF99_V4|414 | 1011 | B1.0|REF99_V4|42104 | 54 | 32 | 32 | 16 | | | | | | | | | | | | | | | | | | | | |
| 1430 | 648 | B1.0|REF99_V4|414 | 613 | B1.0|REF99_V4|42200 | 54 | 23 | 23 | 12 | | | | | | | | | | | | | | | | | | | | |

TABLE 14-continued

| A PAIR | B Endophyte 1 (SEQ ID) | C Endophyte 1 (OTU) | D Endophyte 2 (SEQ ID) | E Endophyte 2 (OTU) | F Bacteria - dicots | | | | G Bacteria - dicots, roots | | | | H Bacteria - dicots, seeds | | | | I Fungi - dicots | | | | J Fungi - dicots, roots | | | | K Fungi - dicots, seeds | | | |
|---|---|---|---|---|---|---|---|---|---|---|---|---|---|---|---|---|---|---|---|---|---|---|---|---|---|---|---|---|
| | | | | | N1 | N2 | OC | EC | N1 | N2 | OC | EC | N1 | N2 | OC | EC | N1 | N2 | OC | EC | N1 | N2 | OC | EC | N1 | N2 | OC | EC |
| 1431 | 648 | B1.0|REF99_V4|14 | 131 | B1.0|REF99_V4|251 | 54 | 30 | 29 | 15 | | | | | | | | | | | | | | | | | | | | |
| 1432 | 648 | B1.0|REF99_V4|14 | 1221 | B1.0|REF99_V4|2512 | 54 | 24 | 24 | 12 | | | | | | | | | | | | | | | | | | | | |
| 1433 | 648 | B1.0|REF99_V4|14 | 943 | B1.0|REF99_V4|26030 | 54 | 30 | 30 | 15 | | | | | | | | | | | | | | | | | | | | |
| 1434 | 648 | B1.0|REF99_V4|14 | 963 | B1.0|REF99_V4|33855 | 54 | 36 | 35 | 18 | | | | | | | | | | | | | | | | | | | | |
| 1435 | 648 | B1.0|REF99_V4|14 | 961 | B1.0|REF99_V4|3580 | 54 | 23 | 23 | 12 | | | | | | | | | | | | | | | | | | | | |
| 1436 | 648 | B1.0|REF99_V4|14 | 945 | B1.0|REF99_V4|442 | 54 | 26 | 26 | 13 | | | | | | | | | | | | | | | | | | | | |
| 1437 | 648 | B1.0|REF99_V4|14 | 665 | B1.0|REF99_V4|446 | 54 | 25 | 25 | 13 | | | | | | | | | | | | | | | | | | | | |
| 1438 | 648 | B1.0|REF99_V4|14 | 69 | B1.0|REF99_V4|506 | 54 | 31 | 30 | 16 | | | | | | | | | | | | | | | | | | | | |
| 1439 | 648 | B1.0|REF99_V4|14 | 60 | B1.0|REF99_V4|514 | 54 | 22 | 22 | 11 | | | | | | | | | | | | | | | | | | | | |
| 1440 | 648 | B1.0|REF99_V4|14 | 734 | B1.0|REF99_V4|558 | 54 | 31 | 27 | 16 | | | | | | | | | | | | | | | | | | | | |
| 1441 | 648 | B1.0|REF99_V4|14 | 853 | B1.0|REF99_V4|5965 | 54 | 22 | 22 | 11 | | | | | | | | | | | | | | | | | | | | |
| 1442 | 648 | B1.0|REF99_V4|14 | 319 | B1.0|REF99_V4|70731 | 54 | 25 | 25 | 13 | | | | | | | | | | | | | | | | | | | | |
| 1443 | 648 | B1.0|REF99_V4|14 | 837 | B1.0|REF99_V4|720 | 54 | 47 | 39 | 24 | | | | | | | | | | | | | | | | | | | | |
| 1444 | 648 | B1.0|REF99_V4|14 | 915 | B1.0|REF99_V4|884 | 54 | 33 | 33 | 17 | | | | | | | | | | | | | | | | | | | | |
| 1445 | 648 | B1.0|REF99_V4|14 | 353 | B1.0|REF99_V4|9861 | 54 | 27 | 27 | 14 | | | | | | | | | | | | | | | | | | | | |
| 1446 | 648 | B1.0|REF99_V4|14 | 653 | B1.0|REF99_V4|995 | 54 | 26 | 26 | 13 | | | | | | | | | | | | | | | | | | | | |
| 1447 | 1112 | B1.0|REF99_V4|14460 | 972 | B1.0|REF99_V4|218 | 30 | 34 | 21 | 10 | | | | | | | | | | | | | | | | | | | | |
| 1448 | 739 | B1.0|REF99_V4|1562 | 116 | B1.0|REF99_V4|1567 | 28 | 29 | 19 | 8 | | | | | | | | | | | | | | | | | | | | |
| 1449 | 739 | B1.0|REF99_V4|1562 | 1180 | B1.0|REF99_V4|4166 | 28 | 49 | 26 | 13 | | | | | | | | | | | | | | | | | | | | |
| 1450 | 739 | B1.0|REF99_V4|1562 | 656 | B1.0|REF99_V4|4191 | 28 | 22 | 22 | 10 | | | | | | | | | | | | | | | | | | | | |
| 1451 | 739 | B1.0|REF99_V4|1562 | 1011 | B1.0|REF99_V4|42104 | 28 | 32 | 24 | 8 | | | | | | | | | | | | | | | | | | | | |
| 1452 | 739 | B1.0|REF99_V4|1562 | 789 | B1.0|REF99_V4|42172 | 28 | 38 | 25 | 10 | | | | | | | | | | | | | | | | | | | | |
| 1453 | 739 | B1.0|REF99_V4|1562 | 810 | B1.0|REF99_V4|4250 | 28 | 26 | 18 | 7 | | | | | | | | | | | | | | | | | | | | |
| 1454 | 739 | B1.0|REF99_V4|1562 | 131 | B1.0|REF99_V4|251 | 28 | 30 | 19 | 8 | | | | | | | | | | | | | | | | | | | | |
| 1455 | 739 | B1.0|REF99_V4|1562 | 1221 | B1.0|REF99_V4|2512 | 28 | 24 | 19 | 6 | | | | | | | | | | | | | | | | | | | | |
| 1456 | 739 | B1.0|REF99_V4|1562 | 943 | B1.0|REF99_V4|26030 | 28 | 30 | 20 | 8 | | | | | | | | | | | | | | | | | | | | |
| 1457 | 739 | B1.0|REF99_V4|1562 | 615 | B1.0|REF99_V4|3374 | 28 | 32 | 22 | 8 | | | | | | | | | | | | | | | | | | | | |
| 1458 | 739 | B1.0|REF99_V4|1562 | 963 | B1.0|REF99_V4|33855 | 28 | 36 | 23 | 9 | | | | | | | | | | | | | | | | | | | | |
| 1459 | 739 | B1.0|REF99_V4|1562 | 961 | B1.0|REF99_V4|3580 | 28 | 23 | 17 | 6 | | | | | | | | | | | | | | | | | | | | |
| 1460 | 739 | B1.0|REF99_V4|1562 | 945 | B1.0|REF99_V4|442 | 28 | 26 | 20 | 7 | | | | | | | | | | | | | | | | | | | | |
| 1461 | 739 | B1.0|REF99_V4|1562 | 665 | B1.0|REF99_V4|446 | 28 | 25 | 19 | 7 | | | | | | | | | | | | | | | | | | | | |
| 1462 | 739 | B1.0|REF99_V4|1562 | 69 | B1.0|REF99_V4|506 | 28 | 31 | 22 | 8 | | | | | | | | | | | | | | | | | | | | |
| 1463 | 739 | B1.0|REF99_V4|1562 | 837 | B1.0|REF99_V4|1720 | 28 | 47 | 27 | 12 | | | | | | | | | | | | | | | | | | | | |
| 1464 | 739 | B1.0|REF99_V4|1562 | 713 | B1.0|REF99_V4|4754 | 28 | 37 | 24 | 10 | | | | | | | | | | | | | | | | | | | | |
| 1465 | 739 | B1.0|REF99_V4|1562 | 915 | B1.0|REF99_V4|884 | 28 | 33 | 22 | 9 | | | | | | | | | | | | | | | | | | | | |
| 1466 | 739 | B1.0|REF99_V4|1562 | 1007 | B1.0|REF99_V4|49526 | 28 | 39 | 25 | 10 | | | | | | | | | | | | | | | | | | | | |
| 1467 | 739 | B1.0|REF99_V4|1562 | 353 | B1.0|REF99_V4|9861 | 28 | 27 | 18 | 7 | | | | | | | | | | | | | | | | | | | | |
| 1468 | 739 | B1.0|REF99_V4|1562 | 653 | B1.0|REF99_V4|995 | 28 | 26 | 20 | 7 | | | | | | | | | | | | | | | | | | | | |
| 1469 | 116 | B1.0|REF99_V4|1567 | 1180 | B1.0|REF99_V4|4166 | 29 | 49 | 24 | 13 | | | | | | | | | | | | | | | | | | | | |
| 1470 | 116 | B1.0|REF99_V4|1567 | 656 | B1.0|REF99_V4|4191 | 29 | 38 | 23 | 10 | | | | | | | | | | | | | | | | | | | | |
| 1471 | 116 | B1.0|REF99_V4|1567 | 613 | B1.0|REF99_V4|42200 | 29 | 23 | 17 | 6 | | | | | | | | | | | | | | | | | | | | |
| 1472 | 116 | B1.0|REF99_V4|1567 | 963 | B1.0|REF99_V4|33855 | 29 | 36 | 22 | 10 | | | | | | | | | | | | | | | | | | | | |
| 1473 | 116 | B1.0|REF99_V4|1567 | 961 | B1.0|REF99_V4|3580 | 29 | 23 | 19 | 6 | | | | | | | | | | | | | | | | | | | | |
| 1474 | 116 | B1.0|REF99_V4|1567 | 60 | B1.0|REF99_V4|514 | 29 | 22 | 17 | 6 | | | | | | | | | | | | | | | | | | | | |
| 1475 | 116 | B1.0|REF99_V4|1567 | 853 | B1.0|REF99_V4|5965 | 29 | 22 | 19 | 6 | | | | | | | | | | | | | | | | | | | | |
| 1476 | 116 | B1.0|REF99_V4|1567 | 319 | B1.0|REF99_V4|70731 | 29 | 25 | 20 | 7 | | | | | | | | | | | | | | | | | | | | |

TABLE 14-continued

| A PAIR | B Endophyte 1 (SEQ ID) | C Endophyte 1 (OTU) | D Endophyte 2 (SEQ ID) | E Endophyte 2 (OTU) | F Bacteria - dicots | | | | G Bacteria - dicots, roots | | | | H Bacteria - dicots, seeds | | | | I Fungi - dicots | | | | J Fungi - dicots, roots | | | | K Fungi - dicots, seeds | | | |
|---|---|---|---|---|---|---|---|---|---|---|---|---|---|---|---|---|---|---|---|---|---|---|---|---|---|---|---|---|
| | | | | | N1 | N2 | OC | EC | N1 | N2 | OC | EC | N1 | N2 | OC | EC | N1 | N2 | OC | EC | N1 | N2 | OC | EC | N1 | N2 | OC | EC |
| 1477 | 116 | B1.0iREF99_V4|1567 | 353 | B1.0iREF99_V4|9861 | 29 | 27 | 19 | 7 | | | | | | | | | | | | | | | | | | | | |
| 1478 | 116 | B1.0iREF99_V4|1567 | 653 | B1.0iREF99_V4|995 | 29 | 26 | 19 | 7 | | | | | | | | | | | | | | | | | | | | |
| 1479 | 1180 | B1.0iREF99_V4|166 | 656 | B1.0iREF99_V4|191 | 49 | 38 | 31 | 17 | | | | | | | | | | | | | | | | | | | | |
| 1480 | 1180 | B1.0iREF99_V4|166 | 1011 | B1.0iREF99_V4|2104 | 49 | 32 | 29 | 15 | | | | | | | | | | | | | | | | | | | | |
| 1481 | 1180 | B1.0iREF99_V4|166 | 810 | B1.0iREF99_V4|250 | 49 | 26 | 24 | 12 | | | | | | | | | | | | | | | | | | | | |
| 1482 | 1180 | B1.0iREF99_V4|166 | 131 | B1.0iREF99_V4|251 | 49 | 30 | 26 | 14 | | | | | | | | | | | | | | | | | | | | |
| 1483 | 1180 | B1.0iREF99_V4|166 | 1221 | B1.0iREF99_V4|2512 | 49 | 24 | 22 | 11 | | | | | | | | | | | | | | | | | | | | |
| 1484 | 1180 | B1.0iREF99_V4|166 | 943 | B1.0iREF99_V4|26030 | 49 | 30 | 26 | 14 | | | | | | | | | | | | | | | | | | | | |
| 1485 | 1180 | B1.0iREF99_V4|166 | 615 | B1.0iREF99_V4|3374 | 49 | 32 | 29 | 15 | | | | | | | | | | | | | | | | | | | | |
| 1486 | 1180 | B1.0iREF99_V4|166 | 963 | B1.0iREF99_V4|33855 | 49 | 36 | 30 | 17 | | | | | | | | | | | | | | | | | | | | |
| 1487 | 1180 | B1.0iREF99_V4|166 | 961 | B1.0iREF99_V4|3580 | 49 | 23 | 22 | 11 | | | | | | | | | | | | | | | | | | | | |
| 1488 | 1180 | B1.0iREF99_V4|166 | 945 | B1.0iREF99_V4|442 | 49 | 26 | 24 | 12 | | | | | | | | | | | | | | | | | | | | |
| 1489 | 1180 | B1.0iREF99_V4|166 | 665 | B1.0iREF99_V4|446 | 49 | 25 | 25 | 11 | | | | | | | | | | | | | | | | | | | | |
| 1490 | 1180 | B1.0iREF99_V4|166 | 69 | B1.0iREF99_V4|506 | 49 | 31 | 26 | 14 | | | | | | | | | | | | | | | | | | | | |
| 1491 | 1180 | B1.0iREF99_V4|166 | 60 | B1.0iREF99_V4|514 | 49 | 22 | 21 | 10 | | | | | | | | | | | | | | | | | | | | |
| 1492 | 1180 | B1.0iREF99_V4|166 | 734 | B1.0iREF99_V4|558 | 49 | 31 | 26 | 14 | | | | | | | | | | | | | | | | | | | | |
| 1493 | 1180 | B1.0iREF99_V4|166 | 853 | B1.0iREF99_V4|5965 | 49 | 22 | 21 | 10 | | | | | | | | | | | | | | | | | | | | |
| 1494 | 1180 | B1.0iREF99_V4|166 | 319 | B1.0iREF99_V4|70731 | 49 | 25 | 23 | 11 | | | | | | | | | | | | | | | | | | | | |
| 1495 | 1180 | B1.0iREF99_V4|166 | 837 | B1.0iREF99_V4|720 | 49 | 47 | 34 | 22 | | | | | | | | | | | | | | | | | | | | |
| 1496 | 1180 | B1.0iREF99_V4|166 | 713 | B1.0iREF99_V4|754 | 49 | 37 | 32 | 17 | | | | | | | | | | | | | | | | | | | | |
| 1497 | 1180 | B1.0iREF99_V4|166 | 915 | B1.0iREF99_V4|884 | 49 | 33 | 29 | 15 | | | | | | | | | | | | | | | | | | | | |
| 1498 | 1180 | B1.0iREF99_V4|166 | 1007 | B1.0iREF99_V4|9526 | 49 | 39 | 31 | 18 | | | | | | | | | | | | | | | | | | | | |
| 1499 | 1180 | B1.0iREF99_V4|166 | 353 | B1.0iREF99_V4|9861 | 49 | 27 | 26 | 12 | | | | | | | | | | | | | | | | | | | | |
| 1500 | 1180 | B1.0iREF99_V4|166 | 653 | B1.0iREF99_V4|995 | 49 | 26 | 23 | 12 | | | | | | | | | | | | | | | | | | | | |
| 1501 | 59 | B1.0iREF99_V4|171149 | 656 | B1.0iREF99_V4|191 | 20 | 38 | 18 | 7 | | | | | | | | | | | | | | | | | | | | |
| 1502 | 59 | B1.0iREF99_V4|171149 | 1011 | B1.0iREF99_V4|2104 | 20 | 32 | 17 | 6 | | | | | | | | | | | | | | | | | | | | |
| 1503 | 59 | B1.0iREF99_V4|171149 | 613 | B1.0iREF99_V4|2200 | 20 | 23 | 15 | 4 | | | | | | | | | | | | | | | | | | | | |
| 1504 | 59 | B1.0iREF99_V4|171149 | 943 | B1.0iREF99_V4|26030 | 20 | 30 | 18 | 6 | | | | | | | | | | | | | | | | | | | | |
| 1505 | 59 | B1.0iREF99_V4|171149 | 615 | B1.0iREF99_V4|3374 | 20 | 32 | 17 | 6 | | | | | | | | | | | | | | | | | | | | |
| 1506 | 59 | B1.0iREF99_V4|171149 | 963 | B1.0iREF99_V4|33855 | 20 | 36 | 19 | 7 | | | | | | | | | | | | | | | | | | | | |
| 1507 | 59 | B1.0iREF99_V4|171149 | 1012 | B1.0iREF99_V4|597 | 20 | 34 | 18 | 6 | | | | | | | | | | | | | | | | | | | | |
| 1508 | 59 | B1.0iREF99_V4|171149 | 837 | B1.0iREF99_V4|720 | 20 | 47 | 20 | 9 | | | | | | | | | | | | | | | | | | | | |
| 1509 | 59 | B1.0iREF99_V4|171149 | 713 | B1.0iREF99_V4|754 | 20 | 37 | 19 | 7 | | | | | | | | | | | | | | | | | | | | |
| 1510 | 59 | B1.0iREF99_V4|171149 | 915 | B1.0iREF99_V4|884 | 20 | 33 | 20 | 6 | | | | | | | | | | | | | | | | | | | | |
| 1511 | 59 | B1.0iREF99_V4|171149 | 1007 | B1.0iREF99_V4|9526 | 20 | 39 | 19 | 7 | | | | | | | | | | | | | | | | | | | | |
| 1512 | 313 | B1.0iREF99_V4|18024 | 1011 | B1.0iREF99_V4|2104 | 21 | 32 | 19 | 6 | | | | | | | | | | | | | | | | | | | | |
| 1513 | 313 | B1.0iREF99_V4|18024 | 810 | B1.0iREF99_V4|250 | 21 | 26 | 16 | 5 | | | | | | | | | | | | | | | | | | | | |
| 1514 | 313 | B1.0iREF99_V4|18024 | 1221 | B1.0iREF99_V4|2512 | 21 | 24 | 16 | 5 | | | | | | | | | | | | | | | | | | | | |
| 1515 | 313 | B1.0iREF99_V4|18024 | 943 | B1.0iREF99_V4|26030 | 21 | 30 | 17 | 6 | | | | | | | | | | | | | | | | | | | | |
| 1516 | 313 | B1.0iREF99_V4|18024 | 963 | B1.0iREF99_V4|33855 | 21 | 36 | 18 | 7 | | | | | | | | | | | | | | | | | | | | |
| 1517 | 313 | B1.0iREF99_V4|18024 | 916 | B1.0iREF99_V4|3675 | 21 | 37 | 21 | 7 | | | | | | | | | | | | | | | | | | | | |
| 1518 | 313 | B1.0iREF99_V4|18024 | 945 | B1.0iREF99_V4|442 | 21 | 26 | 16 | 5 | | | | | | | | | | | | | | | | | | | | |
| 1519 | 313 | B1.0iREF99_V4|18024 | 665 | B1.0iREF99_V4|446 | 21 | 25 | 16 | 5 | | | | | | | | | | | | | | | | | | | | |
| 1520 | 313 | B1.0iREF99_V4|18024 | 1012 | B1.0iREF99_V4|597 | 21 | 34 | 19 | 7 | | | | | | | | | | | | | | | | | | | | |
| 1521 | 313 | B1.0iREF99_V4|18024 | 837 | B1.0iREF99_V4|720 | 21 | 47 | 21 | 9 | | | | | | | | | | | | | | | | | | | | |
| 1522 | 313 | B1.0iREF99_V4|18024 | 915 | B1.0iREF99_V4|884 | 21 | 33 | 18 | 7 | | | | | | | | | | | | | | | | | | | | |

TABLE 14-continued

| A PAIR | B Endophyte 1 (SEQ ID) | C Endophyte 1 (OTU) | D Endophyte 2 (SEQ ID) | E Endophyte 2 (OTU) | F Bacteria - dicots | | | | G Bacteria - dicots, roots | | | | H Bacteria - dicots, seeds | | | | I Fungi - dicots | | | | J Fungi - dicots, roots | | | | K Fungi - dicots, seeds | | | |
|---|---|---|---|---|---|---|---|---|---|---|---|---|---|---|---|---|---|---|---|---|---|---|---|---|---|---|---|---|
| | | | | | N1 | N2 | OC | EC | N1 | N2 | OC | EC | N1 | N2 | OC | EC | N1 | N2 | OC | EC | N1 | N2 | OC | EC | N1 | N2 | OC | EC |
| 1523 | 313 | B1.0iREF99_V4|18024 | 1007 | B1.0iREF99_V4|9526 | 21 | 39 | 20 | 8 | | | | | | | | | | | | | | | | | | | | |
| 1524 | 889 | B1.0iREF99_V4|185 | 656 | B1.0iREF99_V4|191 | 28 | 38 | 21 | 10 | | | | | | | | | | | | | | | | | | | | |
| 1525 | 889 | B1.0iREF99_V4|185 | 69 | B1.0iREF99_V4|506 | 28 | 31 | 20 | 8 | | | | | | | | | | | | | | | | | | | | |
| 1526 | 889 | B1.0iREF99_V4|185 | 713 | B1.0iREF99_V4|754 | 28 | 37 | 21 | 10 | | | | | | | | | | | | | | | | | | | | |
| 1527 | 656 | B1.0iREF99_V4|191 | 1011 | B1.0iREF99_V4|2104 | 38 | 32 | 26 | 11 | | | | | | | | | | | | | | | | | | | | |
| 1528 | 656 | B1.0iREF99_V4|191 | 1221 | B1.0iREF99_V4|2512 | 38 | 24 | 21 | 9 | | | | | | | | | | | | | | | | | | | | |
| 1529 | 656 | B1.0iREF99_V4|191 | 943 | B1.0iREF99_V4|26030 | 38 | 30 | 25 | 11 | | | | | | | | | | | | | | | | | | | | |
| 1530 | 656 | B1.0iREF99_V4|191 | 963 | B1.0iREF99_V4|33855 | 38 | 36 | 29 | 13 | | | | | | | | | | | | | | | | | | | | |
| 1531 | 656 | B1.0iREF99_V4|191 | 945 | B1.0iREF99_V4|4442 | 38 | 26 | 21 | 9 | | | | | | | | | | | | | | | | | | | | |
| 1532 | 656 | B1.0iREF99_V4|191 | 665 | B1.0iREF99_V4|4446 | 38 | 25 | 20 | 9 | | | | | | | | | | | | | | | | | | | | |
| 1533 | 656 | B1.0iREF99_V4|191 | 69 | B1.0iREF99_V4|506 | 38 | 31 | 26 | 11 | | | | | | | | | | | | | | | | | | | | |
| 1534 | 656 | B1.0iREF99_V4|191 | 734 | B1.0iREF99_V4|558 | 38 | 31 | 22 | 11 | | | | | | | | | | | | | | | | | | | | |
| 1535 | 656 | B1.0iREF99_V4|191 | 1106 | B1.0iREF99_V4|66 | 38 | 74 | 37 | 26 | | | | | | | | | | | | | | | | | | | | |
| 1536 | 656 | B1.0iREF99_V4|191 | 319 | B1.0iREF99_V4|170731 | 38 | 25 | 20 | 9 | | | | | | | | | | | | | | | | | | | | |
| 1537 | 656 | B1.0iREF99_V4|191 | 968 | B1.0iREF99_V4|972 | 38 | 19 | 18 | 7 | | | | | | | | | | | | | | | | | | | | |
| 1538 | 656 | B1.0iREF99_V4|191 | 353 | B1.0iREF99_V4|9861 | 38 | 27 | 22 | 10 | | | | | | | | | | | | | | | | | | | | |
| 1539 | 656 | B1.0iREF99_V4|191 | 653 | B1.0iREF99_V4|995 | 38 | 26 | 22 | 9 | | | | | | | | | | | | | | | | | | | | |
| 1540 | 1011 | B1.0iREF99_V4|2104 | 613 | B1.0iREF99_V4|2200 | 32 | 23 | 20 | 7 | | | | | | | | | | | | | | | | | | | | |
| 1541 | 1011 | B1.0iREF99_V4|2104 | 887 | B1.0iREF99_V4|2238 | 32 | 19 | 17 | 6 | | | | | | | | | | | | | | | | | | | | |
| 1542 | 1011 | B1.0iREF99_V4|2104 | 1221 | B1.0iREF99_V4|2512 | 32 | 24 | 21 | 7 | | | | | | | | | | | | | | | | | | | | |
| 1543 | 1011 | B1.0iREF99_V4|2104 | 961 | B1.0iREF99_V4|3580 | 32 | 23 | 20 | 7 | | | | | | | | | | | | | | | | | | | | |
| 1544 | 1011 | B1.0iREF99_V4|2104 | 719 | B1.0iREF99_V4|385 | 32 | 41 | 24 | 12 | | | | | | | | | | | | | | | | | | | | |
| 1545 | 1011 | B1.0iREF99_V4|2104 | 665 | B1.0iREF99_V4|4446 | 32 | 25 | 23 | 8 | | | | | | | | | | | | | | | | | | | | |
| 1546 | 1011 | B1.0iREF99_V4|2104 | 60 | B1.0iREF99_V4|514 | 32 | 22 | 21 | 7 | | | | | | | | | | | | | | | | | | | | |
| 1547 | 1011 | B1.0iREF99_V4|2104 | 734 | B1.0iREF99_V4|558 | 32 | 31 | 22 | 9 | | | | | | | | | | | | | | | | | | | | |
| 1548 | 1011 | B1.0iREF99_V4|2104 | 853 | B1.0iREF99_V4|5965 | 32 | 22 | 19 | 7 | | | | | | | | | | | | | | | | | | | | |
| 1549 | 1011 | B1.0iREF99_V4|2104 | 1177 | B1.0iREF99_V4|64 | 32 | 40 | 23 | 12 | | | | | | | | | | | | | | | | | | | | |
| 1550 | 1011 | B1.0iREF99_V4|2104 | 319 | B1.0iREF99_V4|170731 | 32 | 25 | 21 | 8 | | | | | | | | | | | | | | | | | | | | |
| 1551 | 1011 | B1.0iREF99_V4|2104 | 968 | B1.0iREF99_V4|972 | 32 | 19 | 18 | 6 | | | | | | | | | | | | | | | | | | | | |
| 1552 | 1011 | B1.0iREF99_V4|2104 | 353 | B1.0iREF99_V4|9861 | 32 | 27 | 23 | 8 | | | | | | | | | | | | | | | | | | | | |
| 1553 | 1011 | B1.0iREF99_V4|2104 | 653 | B1.0iREF99_V4|995 | 32 | 26 | 21 | 8 | | | | | | | | | | | | | | | | | | | | |
| 1554 | 789 | B1.0iREF99_V4|2172 | 887 | B1.0iREF99_V4|2238 | 38 | 19 | 18 | 7 | | | | | | | | | | | | | | | | | | | | |
| 1555 | 789 | B1.0iREF99_V4|2172 | 1221 | B1.0iREF99_V4|2512 | 38 | 24 | 23 | 9 | | | | | | | | | | | | | | | | | | | | |
| 1556 | 789 | B1.0iREF99_V4|2172 | 961 | B1.0iREF99_V4|3580 | 38 | 23 | 21 | 8 | | | | | | | | | | | | | | | | | | | | |
| 1557 | 789 | B1.0iREF99_V4|2172 | 665 | B1.0iREF99_V4|4446 | 38 | 25 | 24 | 9 | | | | | | | | | | | | | | | | | | | | |
| 1558 | 789 | B1.0iREF99_V4|2172 | 853 | B1.0iREF99_V4|5965 | 38 | 22 | 19 | 8 | | | | | | | | | | | | | | | | | | | | |
| 1559 | 789 | B1.0iREF99_V4|2172 | 1106 | B1.0iREF99_V4|66 | 38 | 74 | 37 | 26 | | | | | | | | | | | | | | | | | | | | |
| 1560 | 789 | B1.0iREF99_V4|2172 | 968 | B1.0iREF99_V4|972 | 32 | 19 | 18 | 7 | | | | | | | | | | | | | | | | | | | | |
| 1561 | 789 | B1.0iREF99_V4|2172 | 353 | B1.0iREF99_V4|9861 | 38 | 27 | 25 | 10 | | | | | | | | | | | | | | | | | | | | |
| 1562 | 789 | B1.0iREF99_V4|2172 | 653 | B1.0iREF99_V4|995 | 38 | 26 | 24 | 9 | | | | | | | | | | | | | | | | | | | | |
| 1563 | 613 | B1.0iREF99_V4|2200 | 887 | B1.0iREF99_V4|2238 | 23 | 19 | 15 | 4 | | | | | | | | | | | | | | | | | | | | |
| 1564 | 613 | B1.0iREF99_V4|2200 | 681 | B1.0iREF99_V4|234 | 23 | 41 | 20 | 9 | | | | | | | | | | | | | | | | | | | | |
| 1565 | 613 | B1.0iREF99_V4|2200 | 683 | B1.0iREF99_V4|2385 | 23 | 20 | 16 | 4 | | | | | | | | | | | | | | | | | | | | |
| 1566 | 613 | B1.0iREF99_V4|2200 | 131 | B1.0iREF99_V4|251 | 23 | 30 | 18 | 6 | | | | | | | | | | | | | | | | | | | | |
| 1567 | 613 | B1.0iREF99_V4|2200 | 943 | B1.0iREF99_V4|26030 | 23 | 30 | 20 | 6 | | | | | | | | | | | | | | | | | | | | |
| 1568 | 613 | B1.0iREF99_V4|2200 | 963 | B1.0iREF99_V4|33855 | 23 | 36 | 22 | 8 | | | | | | | | | | | | | | | | | | | | |

TABLE 14-continued

| PAIR | Endophyte 1 (SEQ ID) | Endophyte 1 (OTU) | Endophyte 2 (SEQ ID) | Endophyte 2 (OTU) | F Bacteria - dicots N1 | N2 | OC | EC |
|---|---|---|---|---|---|---|---|---|
| 1569 | 613 | B1.0iREF99_V4i2200 | 945 | B1.0iREF99_V4i442 | 23 | 26 | 17 | 6 |
| 1570 | 613 | B1.0iREF99_V4i2200 | 69 | B1.0iREF99_V4i506 | 23 | 31 | 19 | 7 |
| 1571 | 613 | B1.0iREF99_V4i2200 | 1012 | B1.0iREF99_V4i597 | 23 | 34 | 20 | 7 |
| 1572 | 613 | B1.0iREF99_V4i2200 | 319 | B1.0iREF99_V4i70731 | 23 | 25 | 19 | 5 |
| 1573 | 613 | B1.0iREF99_V4i2200 | 837 | B1.0iREF99_V4i720 | 23 | 47 | 23 | 10 |
| 1574 | 613 | B1.0iREF99_V4i2200 | 353 | B1.0iREF99_V4i9861 | 23 | 27 | 17 | 6 |
| 1575 | 887 | B1.0iREF99_V4i2238 | 615 | B1.0iREF99_V4i3374 | 19 | 32 | 17 | 6 |
| 1576 | 887 | B1.0iREF99_V4i2238 | 963 | B1.0iREF99_V4i33855 | 19 | 36 | 18 | 6 |
| 1577 | 887 | B1.0iREF99_V4i2238 | 916 | B1.0iREF99_V4i3675 | 19 | 37 | 19 | 7 |
| 1578 | 887 | B1.0iREF99_V4i2238 | 1012 | B1.0iREF99_V4i597 | 19 | 34 | 17 | 6 |
| 1579 | 887 | B1.0iREF99_V4i2238 | 837 | B1.0iREF99_V4i720 | 19 | 47 | 19 | 8 |
| 1580 | 887 | B1.0iREF99_V4i2238 | 713 | B1.0iREF99_V4i754 | 19 | 37 | 18 | 7 |
| 1581 | 887 | B1.0iREF99_V4i2238 | 915 | B1.0iREF99_V4i884 | 19 | 33 | 19 | 6 |
| 1582 | 887 | B1.0iREF99_V4i2238 | 1007 | B1.0iREF99_V4i9526 | 19 | 39 | 19 | 7 |
| 1583 | 681 | B1.0iREF99_V4i234 | 943 | B1.0iREF99_V4i26030 | 41 | 30 | 23 | 12 |
| 1584 | 681 | B1.0iREF99_V4i234 | 615 | B1.0iREF99_V4i3374 | 41 | 32 | 23 | 12 |
| 1585 | 681 | B1.0iREF99_V4i234 | 961 | B1.0iREF99_V4i3580 | 41 | 23 | 20 | 9 |
| 1586 | 681 | B1.0iREF99_V4i234 | 1177 | B1.0iREF99_V4i464 | 41 | 40 | 26 | 15 |
| 1587 | 681 | B1.0iREF99_V4i234 | 713 | B1.0iREF99_V4i754 | 41 | 37 | 27 | 14 |
| 1588 | 681 | B1.0iREF99_V4i234 | 915 | B1.0iREF99_V4i884 | 41 | 33 | 25 | 13 |
| 1589 | 683 | B1.0iREF99_V4i2385 | 943 | B1.0iREF99_V4i26030 | 20 | 30 | 17 | 4 |
| 1590 | 683 | B1.0iREF99_V4i2385 | 961 | B1.0iREF99_V4i3580 | 20 | 23 | 15 | 5 |
| 1591 | 683 | B1.0iREF99_V4i2385 | 945 | B1.0iREF99_V4i442 | 20 | 26 | 16 | 5 |
| 1592 | 683 | B1.0iREF99_V4i2385 | 69 | B1.0iREF99_V4i506 | 20 | 31 | 17 | 7 |
| 1593 | 683 | B1.0iREF99_V4i2385 | 853 | B1.0iREF99_V4i5965 | 20 | 22 | 15 | 4 |
| 1594 | 683 | B1.0iREF99_V4i2385 | 319 | B1.0iREF99_V4i70731 | 20 | 25 | 16 | 5 |
| 1595 | 683 | B1.0iREF99_V4i2385 | 837 | B1.0iREF99_V4i720 | 20 | 47 | 20 | 9 |
| 1596 | 683 | B1.0iREF99_V4i2385 | 713 | B1.0iREF99_V4i754 | 20 | 37 | 19 | 7 |
| 1597 | 683 | B1.0iREF99_V4i2385 | 915 | B1.0iREF99_V4i884 | 20 | 33 | 19 | 6 |
| 1598 | 683 | B1.0iREF99_V4i2385 | 353 | B1.0iREF99_V4i9861 | 20 | 27 | 16 | 5 |
| 1599 | 683 | B1.0iREF99_V4i2385 | 653 | B1.0iREF99_V4i995 | 20 | 26 | 19 | 5 |
| 1600 | 810 | B1.0iREF99_V4i250 | 1221 | B1.0iREF99_V4i2512 | 26 | 24 | 15 | 6 |
| 1601 | 810 | B1.0iREF99_V4i250 | 665 | B1.0iREF99_V4i446 | 26 | 25 | 18 | 6 |
| 1602 | 810 | B1.0iREF99_V4i250 | 853 | B1.0iREF99_V4i5965 | 26 | 22 | 19 | 5 |
| 1603 | 810 | B1.0iREF99_V4i250 | 353 | B1.0iREF99_V4i9861 | 26 | 27 | 19 | 7 |
| 1604 | 810 | B1.0iREF99_V4i250 | 653 | B1.0iREF99_V4i995 | 26 | 26 | 17 | 6 |
| 1605 | 131 | B1.0iREF99_V4i251 | 945 | B1.0iREF99_V4i442 | 30 | 31 | 23 | 9 |
| 1606 | 131 | B1.0iREF99_V4i251 | 69 | B1.0iREF99_V4i506 | 30 | 26 | 18 | 7 |
| 1607 | 131 | B1.0iREF99_V4i251 | 60 | B1.0iREF99_V4i514 | 30 | 22 | 17 | 6 |
| 1608 | 131 | B1.0iREF99_V4i251 | 353 | B1.0iREF99_V4i9861 | 30 | 27 | 19 | 8 |
| 1609 | 1221 | B1.0iREF99_V4i2512 | 943 | B1.0iREF99_V4i26030 | 24 | 30 | 21 | 7 |
| 1610 | 1221 | B1.0iREF99_V4i2512 | 974 | B1.0iREF99_V4i2831 | 24 | 25 | 24 | 8 |
| 1611 | 1221 | B1.0iREF99_V4i2512 | 615 | B1.0iREF99_V4i3374 | 24 | 37 | 22 | 8 |
| 1612 | 1221 | B1.0iREF99_V4i2512 | 963 | B1.0iREF99_V4i33855 | 24 | 36 | 20 | 7 |
| 1613 | 1221 | B1.0iREF99_V4i2512 | 916 | B1.0iREF99_V4i3675 | 24 | 37 | 24 | 8 |
| 1614 | 1221 | B1.0iREF99_V4i2512 | 945 | B1.0iREF99_V4i442 | 24 | 26 | 17 | 6 |

TABLE 14-continued

| A PAIR | B Endophyte 1 (SEQ ID) | C Endophyte 1 (OTU) | D Endophyte 2 (SEQ ID) | E Endophyte 2 (OTU) | F Bacteria - dicots | | | | G Bacteria - dicots, roots | | | | H Bacteria - dicots, seeds | | | | I Fungi - dicots | | | | J Fungi - dicots, roots | | | | K Fungi - dicots, seeds | | | |
|---|---|---|---|---|---|---|---|---|---|---|---|---|---|---|---|---|---|---|---|---|---|---|---|---|---|---|---|---|
| | | | | | N1 | N2 | OC | EC | N1 | N2 | OC | EC | N1 | N2 | OC | EC | N1 | N2 | OC | EC | N1 | N2 | OC | EC | N1 | N2 | OC | EC |
| 1615 | 1221 | B1.0|REF99_V4|2512 | 69 | B1.0|REF99_V4|506 | 24 | 31 | 19 | 7 | | | | | | | | | | | | | | | | | | | | |
| 1616 | 1221 | B1.0|REF99_V4|2512 | 734 | B1.0|REF99_V4|558 | 24 | 31 | 19 | 7 | | | | | | | | | | | | | | | | | | | | |
| 1617 | 1221 | B1.0|REF99_V4|2512 | 1012 | B1.0|REF99_V4|597 | 24 | 34 | 23 | 8 | | | | | | | | | | | | | | | | | | | | |
| 1618 | 1221 | B1.0|REF99_V4|2512 | 319 | B1.0|REF99_V4|70731 | 24 | 25 | 18 | 6 | | | | | | | | | | | | | | | | | | | | |
| 1619 | 1221 | B1.0|REF99_V4|2512 | 837 | B1.0|REF99_V4|720 | 24 | 47 | 24 | 11 | | | | | | | | | | | | | | | | | | | | |
| 1620 | 1221 | B1.0|REF99_V4|2512 | 713 | B1.0|REF99_V4|754 | 24 | 37 | 22 | 8 | | | | | | | | | | | | | | | | | | | | |
| 1621 | 1221 | B1.0|REF99_V4|2512 | 915 | B1.0|REF99_V4|884 | 24 | 33 | 22 | 7 | | | | | | | | | | | | | | | | | | | | |
| 1622 | 1221 | B1.0|REF99_V4|2512 | 1007 | B1.0|REF99_V4|9526 | 24 | 39 | 22 | 9 | | | | | | | | | | | | | | | | | | | | |
| 1623 | 1221 | B1.0|REF99_V4|2512 | 353 | B1.0|REF99_V4|9861 | 24 | 27 | 19 | 6 | | | | | | | | | | | | | | | | | | | | |
| 1624 | 1221 | B1.0|REF99_V4|2512 | 653 | B1.0|REF99_V4|995 | 24 | 26 | 19 | 6 | | | | | | | | | | | | | | | | | | | | |
| 1625 | 943 | B1.0|REF99_V4|26030 | 961 | B1.0|REF99_V4|3580 | 30 | 23 | 19 | 6 | | | | | | | | | | | | | | | | | | | | |
| 1626 | 943 | B1.0|REF99_V4|26030 | 529 | B1.0|REF99_V4|3983 | 30 | 18 | 16 | 5 | | | | | | | | | | | | | | | | | | | | |
| 1627 | 943 | B1.0|REF99_V4|26030 | 665 | B1.0|REF99_V4|446 | 30 | 25 | 23 | 7 | | | | | | | | | | | | | | | | | | | | |
| 1628 | 943 | B1.0|REF99_V4|26030 | 60 | B1.0|REF99_V4|514 | 30 | 22 | 17 | 6 | | | | | | | | | | | | | | | | | | | | |
| 1629 | 943 | B1.0|REF99_V4|26030 | 734 | B1.0|REF99_V4|558 | 30 | 31 | 23 | 9 | | | | | | | | | | | | | | | | | | | | |
| 1630 | 943 | B1.0|REF99_V4|26030 | 853 | B1.0|REF99_V4|5965 | 30 | 22 | 18 | 6 | | | | | | | | | | | | | | | | | | | | |
| 1631 | 943 | B1.0|REF99_V4|26030 | 319 | B1.0|REF99_V4|70731 | 30 | 25 | 21 | 7 | | | | | | | | | | | | | | | | | | | | |
| 1632 | 943 | B1.0|REF99_V4|26030 | 968 | B1.0|REF99_V4|972 | 30 | 19 | 16 | 5 | | | | | | | | | | | | | | | | | | | | |
| 1633 | 943 | B1.0|REF99_V4|26030 | 353 | B1.0|REF99_V4|9861 | 30 | 27 | 23 | 8 | | | | | | | | | | | | | | | | | | | | |
| 1634 | 943 | B1.0|REF99_V4|26030 | 653 | B1.0|REF99_V4|995 | 30 | 26 | 20 | 7 | | | | | | | | | | | | | | | | | | | | |
| 1635 | 974 | B1.0|REF99_V4|2831 | 529 | B1.0|REF99_V4|3983 | 37 | 18 | 17 | 6 | | | | | | | | | | | | | | | | | | | | |
| 1636 | 974 | B1.0|REF99_V4|2831 | 665 | B1.0|REF99_V4|446 | 37 | 25 | 25 | 9 | | | | | | | | | | | | | | | | | | | | |
| 1637 | 974 | B1.0|REF99_V4|2831 | 853 | B1.0|REF99_V4|5965 | 37 | 22 | 22 | 8 | | | | | | | | | | | | | | | | | | | | |
| 1638 | 974 | B1.0|REF99_V4|2831 | 1177 | B1.0|REF99_V4|464 | 37 | 40 | 26 | 14 | | | | | | | | | | | | | | | | | | | | |
| 1639 | 974 | B1.0|REF99_V4|2831 | 968 | B1.0|REF99_V4|972 | 37 | 19 | 19 | 7 | | | | | | | | | | | | | | | | | | | | |
| 1640 | 974 | B1.0|REF99_V4|2831 | 353 | B1.0|REF99_V4|9861 | 37 | 27 | 26 | 9 | | | | | | | | | | | | | | | | | | | | |
| 1641 | 974 | B1.0|REF99_V4|2831 | 653 | B1.0|REF99_V4|995 | 37 | 26 | 24 | 9 | | | | | | | | | | | | | | | | | | | | |
| 1642 | 615 | B1.0|REF99_V4|3374 | 961 | B1.0|REF99_V4|3580 | 32 | 23 | 19 | 7 | | | | | | | | | | | | | | | | | | | | |
| 1643 | 615 | B1.0|REF99_V4|3374 | 665 | B1.0|REF99_V4|446 | 32 | 25 | 23 | 8 | | | | | | | | | | | | | | | | | | | | |
| 1644 | 615 | B1.0|REF99_V4|3374 | 734 | B1.0|REF99_V4|558 | 32 | 31 | 22 | 9 | | | | | | | | | | | | | | | | | | | | |
| 1645 | 615 | B1.0|REF99_V4|3374 | 853 | B1.0|REF99_V4|5965 | 32 | 22 | 18 | 7 | | | | | | | | | | | | | | | | | | | | |
| 1646 | 615 | B1.0|REF99_V4|3374 | 319 | B1.0|REF99_V4|70731 | 32 | 25 | 22 | 8 | | | | | | | | | | | | | | | | | | | | |
| 1647 | 615 | B1.0|REF99_V4|3374 | 353 | B1.0|REF99_V4|9861 | 32 | 19 | 17 | 6 | | | | | | | | | | | | | | | | | | | | |
| 1648 | 615 | B1.0|REF99_V4|3374 | 968 | B1.0|REF99_V4|972 | 32 | 27 | 24 | 7 | | | | | | | | | | | | | | | | | | | | |
| 1649 | 615 | B1.0|REF99_V4|3374 | 353 | B1.0|REF99_V4|9861 | 32 | 26 | 20 | 8 | | | | | | | | | | | | | | | | | | | | |
| 1650 | 615 | B1.0|REF99_V4|3374 | 653 | B1.0|REF99_V4|995 | 32 | 26 | 19 | 8 | | | | | | | | | | | | | | | | | | | | |
| 1651 | 963 | B1.0|REF99_V4|33855 | 961 | B1.0|REF99_V4|3580 | 36 | 23 | 19 | 8 | | | | | | | | | | | | | | | | | | | | |
| 1652 | 963 | B1.0|REF99_V4|33855 | 665 | B1.0|REF99_V4|446 | 36 | 25 | 21 | 8 | | | | | | | | | | | | | | | | | | | | |
| 1653 | 963 | B1.0|REF99_V4|33855 | 69 | B1.0|REF99_V4|506 | 36 | 31 | 26 | 10 | | | | | | | | | | | | | | | | | | | | |
| 1654 | 963 | B1.0|REF99_V4|33855 | 60 | B1.0|REF99_V4|514 | 36 | 22 | 20 | 7 | | | | | | | | | | | | | | | | | | | | |
| 1655 | 963 | B1.0|REF99_V4|33855 | 818 | B1.0|REF99_V4|531 | 36 | 30 | 21 | 10 | | | | | | | | | | | | | | | | | | | | |
| 1656 | 963 | B1.0|REF99_V4|33855 | 319 | B1.0|REF99_V4|70731 | 36 | 25 | 21 | 8 | | | | | | | | | | | | | | | | | | | | |
| 1657 | 963 | B1.0|REF99_V4|33855 | 353 | B1.0|REF99_V4|9861 | 36 | 27 | 22 | 9 | | | | | | | | | | | | | | | | | | | | |
| 1658 | 963 | B1.0|REF99_V4|33855 | 653 | B1.0|REF99_V4|995 | 36 | 26 | 20 | 9 | | | | | | | | | | | | | | | | | | | | |
| 1659 | 961 | B1.0|REF99_V4|3580 | 945 | B1.0|REF99_V4|442 | 23 | 26 | 18 | 6 | | | | | | | | | | | | | | | | | | | | |
| 1660 | 961 | B1.0|REF99_V4|3580 | 665 | B1.0|REF99_V4|446 | 23 | 25 | 17 | 5 | | | | | | | | | | | | | | | | | | | | |

TABLE 14-continued

| A PAIR | B Endophyte 1 (SEQ ID) | C Endophyte 1 (OTU) | D Endophyte 2 (SEQ ID) | E Endophyte 2 (OTU) | F Bacteria - dicots | | | | G Bacteria - dicots, roots | | | | H Bacteria - dicots, seeds | | | | I Fungi - dicots | | | | J Fungi - dicots, roots | | | | K Fungi - dicots, seeds | | | |
|---|---|---|---|---|---|---|---|---|---|---|---|---|---|---|---|---|---|---|---|---|---|---|---|---|---|---|---|---|
| | | | | | N1 | N2 | OC | EC | N1 | N2 | OC | EC | N1 | N2 | OC | EC | N1 | N2 | OC | EC | N1 | N2 | OC | EC | N1 | N2 | OC | EC |
| 1661 | 961 | B1.0IREF99_V43580 | 1012 | B1.0IREF99_V41597 | 23 | 34 | 21 | 7 | | | | | | | | | | | | | | | | |
| 1662 | 961 | B1.0IREF99_V43580 | 319 | B1.0IREF99_V4170731 | 23 | 25 | 18 | 5 | | | | | | | | | | | | | | | | |
| 1663 | 961 | B1.0IREF99_V43580 | 837 | B1.0IREF99_V41720 | 23 | 47 | 23 | 10 | | | | | | | | | | | | | | | | |
| 1664 | 961 | B1.0IREF99_V43580 | 713 | B1.0IREF99_V41754 | 23 | 37 | 22 | 8 | | | | | | | | | | | | | | | | |
| 1665 | 961 | B1.0IREF99_V43580 | 915 | B1.0IREF99_V4884 | 23 | 33 | 20 | 7 | | | | | | | | | | | | | | | | |
| 1666 | 961 | B1.0IREF99_V43580 | 353 | B1.0IREF99_V49861 | 23 | 27 | 18 | 6 | | | | | | | | | | | | | | | | |
| 1667 | 961 | B1.0IREF99_V43580 | 653 | B1.0IREF99_V4995 | 23 | 26 | 17 | 6 | | | | | | | | | | | | | | | | |
| 1668 | 916 | B1.0IREF99_V43675 | 529 | B1.0IREF99_V43983 | 37 | 18 | 17 | 6 | | | | | | | | | | | | | | | | |
| 1669 | 916 | B1.0IREF99_V43675 | 665 | B1.0IREF99_V4446 | 37 | 25 | 25 | 9 | | | | | | | | | | | | | | | | |
| 1670 | 916 | B1.0IREF99_V43675 | 853 | B1.0IREF99_V45965 | 37 | 22 | 22 | 8 | | | | | | | | | | | | | | | | |
| 1671 | 916 | B1.0IREF99_V43675 | 1177 | B1.0IREF99_V464 | 37 | 40 | 26 | 14 | | | | | | | | | | | | | | | | |
| 1672 | 916 | B1.0IREF99_V43675 | 968 | B1.0IREF99_V4972 | 37 | 19 | 19 | 7 | | | | | | | | | | | | | | | | |
| 1673 | 916 | B1.0IREF99_V43675 | 353 | B1.0IREF99_V49861 | 37 | 27 | 26 | 9 | | | | | | | | | | | | | | | | |
| 1674 | 916 | B1.0IREF99_V43675 | 653 | B1.0IREF99_V4995 | 37 | 26 | 24 | 9 | | | | | | | | | | | | | | | | |
| 1675 | 529 | B1.0IREF99_V43983 | 69 | B1.0IREF99_V4506 | 18 | 31 | 16 | 5 | | | | | | | | | | | | | | | | |
| 1676 | 945 | B1.0IREF99_V4442 | 665 | B1.0IREF99_V4446 | 26 | 25 | 17 | 6 | | | | | | | | | | | | | | | | |
| 1677 | 945 | B1.0IREF99_V4442 | 69 | B1.0IREF99_V4506 | 26 | 31 | 19 | 8 | | | | | | | | | | | | | | | | |
| 1678 | 945 | B1.0IREF99_V4442 | 853 | B1.0IREF99_V45965 | 26 | 22 | 17 | 5 | | | | | | | | | | | | | | | | |
| 1679 | 945 | B1.0IREF99_V4442 | 319 | B1.0IREF99_V4170731 | 26 | 25 | 18 | 6 | | | | | | | | | | | | | | | | |
| 1680 | 945 | B1.0IREF99_V4442 | 915 | B1.0IREF99_V4884 | 26 | 33 | 22 | 8 | | | | | | | | | | | | | | | | |
| 1681 | 945 | B1.0IREF99_V4442 | 353 | B1.0IREF99_V49861 | 26 | 27 | 19 | 7 | | | | | | | | | | | | | | | | |
| 1682 | 945 | B1.0IREF99_V4442 | 653 | B1.0IREF99_V4995 | 26 | 26 | 17 | 6 | | | | | | | | | | | | | | | | |
| 1683 | 665 | B1.0IREF99_V4446 | 69 | B1.0IREF99_V4506 | 25 | 31 | 19 | 7 | | | | | | | | | | | | | | | | |
| 1684 | 665 | B1.0IREF99_V4446 | 60 | B1.0IREF99_V4514 | 25 | 22 | 17 | 5 | | | | | | | | | | | | | | | | |
| 1685 | 665 | B1.0IREF99_V4446 | 853 | B1.0IREF99_V45965 | 25 | 22 | 16 | 5 | | | | | | | | | | | | | | | | |
| 1686 | 665 | B1.0IREF99_V4446 | 1012 | B1.0IREF99_V41597 | 25 | 34 | 23 | 8 | | | | | | | | | | | | | | | | |
| 1687 | 665 | B1.0IREF99_V4446 | 319 | B1.0IREF99_V4170731 | 25 | 25 | 20 | 6 | | | | | | | | | | | | | | | | |
| 1688 | 665 | B1.0IREF99_V4446 | 837 | B1.0IREF99_V41720 | 25 | 47 | 25 | 11 | | | | | | | | | | | | | | | | |
| 1689 | 665 | B1.0IREF99_V4446 | 713 | B1.0IREF99_V41754 | 25 | 37 | 23 | 9 | | | | | | | | | | | | | | | | |
| 1690 | 665 | B1.0IREF99_V4446 | 915 | B1.0IREF99_V4884 | 25 | 33 | 23 | 8 | | | | | | | | | | | | | | | | |
| 1691 | 665 | B1.0IREF99_V4446 | 1007 | B1.0IREF99_V49526 | 25 | 39 | 23 | 9 | | | | | | | | | | | | | | | | |
| 1692 | 665 | B1.0IREF99_V4446 | 353 | B1.0IREF99_V49861 | 25 | 27 | 22 | 6 | | | | | | | | | | | | | | | | |
| 1693 | 665 | B1.0IREF99_V4446 | 653 | B1.0IREF99_V4995 | 25 | 26 | 18 | 6 | | | | | | | | | | | | | | | | |
| 1694 | 69 | B1.0IREF99_V4506 | 60 | B1.0IREF99_V4514 | 31 | 22 | 18 | 6 | | | | | | | | | | | | | | | | |
| 1695 | 69 | B1.0IREF99_V4506 | 734 | B1.0IREF99_V4558 | 31 | 31 | 20 | 9 | | | | | | | | | | | | | | | | |
| 1696 | 69 | B1.0IREF99_V4506 | 853 | B1.0IREF99_V45965 | 31 | 22 | 18 | 6 | | | | | | | | | | | | | | | | |
| 1697 | 69 | B1.0IREF99_V4506 | 1177 | B1.0IREF99_V464 | 31 | 40 | 23 | 12 | | | | | | | | | | | | | | | | |
| 1698 | 69 | B1.0IREF99_V4506 | 319 | B1.0IREF99_V4170731 | 31 | 25 | 19 | 7 | | | | | | | | | | | | | | | | |
| 1699 | 69 | B1.0IREF99_V4506 | 353 | B1.0IREF99_V49861 | 31 | 27 | 19 | 8 | | | | | | | | | | | | | | | | |
| 1700 | 69 | B1.0IREF99_V4506 | 653 | B1.0IREF99_V4995 | 31 | 26 | 21 | 8 | | | | | | | | | | | | | | | | |
| 1701 | 60 | B1.0IREF99_V4514 | 319 | B1.0IREF99_V4170731 | 22 | 25 | 16 | 5 | | | | | | | | | | | | | | | | |
| 1702 | 60 | B1.0IREF99_V4514 | 713 | B1.0IREF99_V41754 | 22 | 37 | 22 | 8 | | | | | | | | | | | | | | | | |
| 1703 | 60 | B1.0IREF99_V4514 | 915 | B1.0IREF99_V4884 | 31 | 26 | 21 | 7 | | | | | | | | | | | | | | | | |
| 1704 | 60 | B1.0IREF99_V4514 | 353 | B1.0IREF99_V49861 | 22 | 27 | 17 | 6 | | | | | | | | | | | | | | | | |
| 1705 | 734 | B1.0IREF99_V4558 | 319 | B1.0IREF99_V4170731 | 31 | 25 | 19 | 7 | | | | | | | | | | | | | | | | |
| 1706 | 734 | B1.0IREF99_V4558 | 915 | B1.0IREF99_V4884 | 31 | 33 | 22 | 10 | | | | | | | | | | | | | | | | |

TABLE 14-continued

| PAIR | Endophyte 1 (SEQ ID) | Endophyte 1 (OTU) | Endophyte 2 (SEQ ID) | Endophyte 2 (OTU) | F Bacteria - dicots N1 | N2 | OC | EC | G Bacteria - dicots, roots N1 | N2 | OC | EC | H Bacteria - dicots, seeds N1 | N2 | OC | EC | I Fungi - dicots N1 | N2 | OC | EC | J Fungi - dicots, roots N1 | N2 | OC | EC | K Fungi - dicots, seeds N1 | N2 | OC | EC |
|---|---|---|---|---|---|---|---|---|---|---|---|---|---|---|---|---|---|---|---|---|---|---|---|---|---|---|---|---|
| 1707 | 734 | B1.0|REF99_V4|558 | 353 | B1.0|REF99_V4|9861 | 31 | 27 | 21 | 8 | | | | | | | | | | | | | | | | | | | | |
| 1708 | 853 | B1.0|REF99_V4|5965 | 1012 | B1.0|REF99_V4|597 | 22 | 34 | 20 | 7 | | | | | | | | | | | | | | | | | | | | |
| 1709 | 853 | B1.0|REF99_V4|5965 | 319 | B1.0|REF99_V4|70731 | 22 | 25 | 18 | 5 | | | | | | | | | | | | | | | | | | | | |
| 1710 | 853 | B1.0|REF99_V4|5965 | 837 | B1.0|REF99_V4|720 | 22 | 47 | 22 | 10 | | | | | | | | | | | | | | | | | | | | |
| 1711 | 853 | B1.0|REF99_V4|5965 | 713 | B1.0|REF99_V4|754 | 22 | 37 | 21 | 8 | | | | | | | | | | | | | | | | | | | | |
| 1712 | 853 | B1.0|REF99_V4|5965 | 915 | B1.0|REF99_V4|884 | 22 | 33 | 20 | 7 | | | | | | | | | | | | | | | | | | | | |
| 1713 | 853 | B1.0|REF99_V4|5965 | 1007 | B1.0|REF99_V4|9526 | 22 | 39 | 21 | 8 | | | | | | | | | | | | | | | | | | | | |
| 1714 | 853 | B1.0|REF99_V4|5965 | 353 | B1.0|REF99_V4|9861 | 22 | 27 | 18 | 6 | | | | | | | | | | | | | | | | | | | | |
| 1715 | 1012 | B1.0|REF99_V4|597 | 1177 | B1.0|REF99_V4|464 | 34 | 40 | 25 | 13 | | | | | | | | | | | | | | | | | | | | |
| 1716 | 1012 | B1.0|REF99_V4|597 | 968 | B1.0|REF99_V4|972 | 34 | 19 | 19 | 6 | | | | | | | | | | | | | | | | | | | | |
| 1717 | 1012 | B1.0|REF99_V4|597 | 353 | B1.0|REF99_V4|9861 | 34 | 27 | 24 | 9 | | | | | | | | | | | | | | | | | | | | |
| 1718 | 1012 | B1.0|REF99_V4|597 | 653 | B1.0|REF99_V4|995 | 34 | 26 | 23 | 8 | | | | | | | | | | | | | | | | | | | | |
| 1719 | 1177 | B1.0|REF99_V4|464 | 837 | B1.0|REF99_V4|720 | 40 | 47 | 32 | 18 | | | | | | | | | | | | | | | | | | | | |
| 1720 | 1177 | B1.0|REF99_V4|464 | 915 | B1.0|REF99_V4|884 | 40 | 33 | 23 | 12 | | | | | | | | | | | | | | | | | | | | |
| 1721 | 1106 | B1.0|REF99_V4|466 | 837 | B1.0|REF99_V4|720 | 74 | 47 | 45 | 33 | | | | | | | | | | | | | | | | | | | | |
| 1722 | 1106 | B1.0|REF99_V4|466 | 1007 | B1.0|REF99_V4|9526 | 74 | 39 | 38 | 27 | | | | | | | | | | | | | | | | | | | | |
| 1723 | 319 | B1.0|REF99_V4|70731 | 915 | B1.0|REF99_V4|884 | 25 | 33 | 23 | 8 | | | | | | | | | | | | | | | | | | | | |
| 1724 | 319 | B1.0|REF99_V4|70731 | 353 | B1.0|REF99_V4|9861 | 25 | 27 | 20 | 6 | | | | | | | | | | | | | | | | | | | | |
| 1725 | 319 | B1.0|REF99_V4|70731 | 653 | B1.0|REF99_V4|995 | 25 | 26 | 18 | 6 | | | | | | | | | | | | | | | | | | | | |
| 1726 | 837 | B1.0|REF99_V4|720 | 968 | B1.0|REF99_V4|972 | 47 | 19 | 19 | 8 | | | | | | | | | | | | | | | | | | | | |
| 1727 | 837 | B1.0|REF99_V4|720 | 353 | B1.0|REF99_V4|9861 | 47 | 27 | 26 | 12 | | | | | | | | | | | | | | | | | | | | |
| 1728 | 653 | B1.0|REF99_V4|995 | 353 | B1.0|REF99_V4|9861 | 47 | 26 | 24 | 11 | | | | | | | | | | | | | | | | | | | | |
| 1729 | 713 | B1.0|REF99_V4|754 | 353 | B1.0|REF99_V4|9861 | 37 | 27 | 23 | 9 | | | | | | | | | | | | | | | | | | | | |
| 1730 | 713 | B1.0|REF99_V4|754 | 653 | B1.0|REF99_V4|995 | 37 | 26 | 23 | 9 | | | | | | | | | | | | | | | | | | | | |
| 1731 | 915 | B1.0|REF99_V4|884 | 968 | B1.0|REF99_V4|972 | 33 | 19 | 17 | 6 | | | | | | | | | | | | | | | | | | | | |
| 1732 | 915 | B1.0|REF99_V4|884 | 353 | B1.0|REF99_V4|9861 | 27 | 27 | 23 | 8 | | | | | | | | | | | | | | | | | | | | |
| 1733 | 653 | B1.0|REF99_V4|995 | 968 | B1.0|REF99_V4|972 | 33 | 26 | 22 | 8 | | | | | | | | | | | | | | | | | | | | |
| 1734 | 1007 | B1.0|REF99_V4|9526 | 968 | B1.0|REF99_V4|972 | 33 | 19 | 18 | 7 | | | | | | | | | | | | | | | | | | | | |
| 1735 | 1007 | B1.0|REF99_V4|9526 | 353 | B1.0|REF99_V4|9861 | 39 | 27 | 24 | 10 | | | | | | | | | | | | | | | | | | | | |
| 1736 | 1007 | B1.0|REF99_V4|9526 | 653 | B1.0|REF99_V4|995 | 39 | 26 | 22 | 10 | | | | | | | | | | | | | | | | | | | | |
| 1737 | 968 | B1.0|REF99_V4|972 | 353 | B1.0|REF99_V4|9861 | 19 | 27 | 16 | 5 | | | | | | | | | | | | | | | | | | | | |
| 1738 | 353 | B1.0|REF99_V4|9861 | 653 | B1.0|REF99_V4|995 | 27 | 26 | 18 | 7 | | | | | | | | | | | | | | | | | | | | |
| 3674 | 1673 | F1.0|SYM97_ITS1F|122 | 1515 | F1.0|SYM97_ITS1F|31 | | | | | | | | | | | | | 26 | 33 | 24 | 15 | | | | | | | | |
| 3675 | 1673 | F1.0|SYM97_ITS1F|122 | 1683 | F1.0|SYM97_ITS1F|51 | | | | | | | | | | | | | 26 | 26 | 21 | 12 | | | | | | | | |
| 3676 | 1673 | F1.0|SYM97_ITS1F|122 | 1682 | F1.0|SYM97_ITS1F|74 | | | | | | | | | | | | | 26 | 29 | 21 | 13 | | | | | | | | |
| 3677 | 1673 | F1.0|SYM97_ITS1F|122 | 1575 | F1.0|UDYN_ITS1F|137 | | | | | | | | | | | | | 26 | 29 | 25 | 13 | | | | | | | | |
| 3678 | 1515 | F1.0|SYM97_ITS1F|31 | 1683 | F1.0|SYM97_ITS1F|51 | | | | | | | | | | | | | 33 | 26 | 25 | 15 | | | | | | | | |
| 3679 | 1515 | F1.0|SYM97_ITS1F|31 | 1682 | F1.0|SYM97_ITS1F|74 | | | | | | | | | | | | | 33 | 29 | 27 | 17 | | | | | | | | |
| 3680 | 1515 | F1.0|SYM97_ITS1F|31 | 1681 | F1.0|SYM97_ITS1F|75 | | | | | | | | | | | | | 33 | 19 | 18 | 11 | | | | | | | | |
| 3681 | 1515 | F1.0|SYM97_ITS1F|31 | 1574 | F1.0|U97_ITS1F|479 | | | | | | | | | | | | | 33 | 26 | 23 | 15 | | | | | | | | |
| 3682 | 1515 | F1.0|SYM97_ITS1F|31 | 1575 | F1.0|UDYN_ITS1F|137 | | | | | | | | | | | | | 33 | 29 | 26 | 17 | | | | | | | | |
| 3683 | 1515 | F1.0|SYM97_ITS1F|31 | 1573 | F1.0|UDYN_ITS1F|60 | | | | | | | | | | | | | 33 | 25 | 22 | 15 | | | | | | | | |
| 3684 | 1515 | F1.0|SYM97_ITS1F|31 | 1557 | F1.0|UDYN_ITS1F|621 | | | | | | | | | | | | | 33 | 24 | 22 | 14 | | | | | | | | |
| 3685 | 1515 | F1.0|SYM97_ITS1F|31 | 1682 | F1.0|SYM97_ITS1F|74 | | | | | | | | | | | | | 26 | 29 | 24 | 13 | | | | | | | | |
| 3686 | 1683 | F1.0|SYM97_ITS1F|51 | 1681 | F1.0|SYM97_ITS1F|75 | | | | | | | | | | | | | 26 | 19 | 18 | 9 | 26 | 19 | 18 | 13 | | | | |
| 3687 | 1683 | F1.0|SYM97_ITS1F|51 | 1575 | F1.0|UDYN_ITS1F|137 | | | | | | | | | | | | | 26 | 29 | 21 | 13 | | | | | | | | |

TABLE 14-continued

| A PAIR | B Endophyte 1 (SEQ ID) | C Endophyte 1 (OTU) | D Endophyte 2 (SEQ ID) | E Endophyte 2 (OTU) | F Bacteria - dicots N1 | N2 | OC | EC | G Bacteria - dicots, roots N1 | N2 | OC | EC | H Bacteria - dicots, seeds N1 | N2 | OC | EC | I Fungi - dicots N1 | N2 | OC | EC | J Fungi - dicots, roots N1 | N2 | OC | EC | K Fungi - dicots, seeds N1 | N2 | OC | EC |
|---|---|---|---|---|---|---|---|---|---|---|---|---|---|---|---|---|---|---|---|---|---|---|---|---|---|---|---|---|
| 3688 | 1683 | F1.0SYM97_ITS1F\|51 | 1557 | F1.0UDYN_ITS1F\|621 | | | | | | | | | | | | | 26 | 24 | 18 | 11 | | | | | | | | |
| 3689 | 1682 | F1.0SYM97_ITS1F\|74 | 1575 | F1.0UDYN_ITS1F\|37 | | | | | | | | | | | | | 29 | 29 | 23 | 15 | | | | | | | | |
| 3690 | 1682 | F1.0SYM97_ITS1F\|74 | 1557 | F1.0UDYN_ITS1F\|621 | | | | | | | | | | | | | 29 | 24 | 20 | 12 | | | | | | | | |
| 3691 | 1574 | F1.0U97_ITS1F\|479 | 1575 | F1.0UDYN_ITS1F\|37 | | | | | | | | | | | | | 26 | 29 | 24 | 13 | | | | | | | | |
| 3692 | 1574 | F1.0U97_ITS1F\|479 | 1573 | F1.0UDYN_ITS1F\|60 | | | | | | | | | | | | | 26 | 25 | 20 | 11 | | | | | | | | |
| 3693 | 1575 | F1.0U97_ITS1F\|479 | 1557 | F1.0UDYN_ITS1F\|621 | | | | | | | | | | | | | 26 | 24 | 18 | 11 | | | | | | | | |
| 3695 | 1575 | F1.0SYM97_ITS1F\|37 | 1573 | F1.0UDYN_ITS1F\|60 | | | | | | | | | | | | | 29 | 25 | 22 | 13 | | | | | | | | |
| 3696 | 1575 | F1.0SYM97_ITS1F\|37 | 1557 | F1.0UDYN_ITS1F\|621 | | | | | | | | | | | | | 29 | 24 | 20 | 12 | | | | | | | | |
| 3697 | 1672 | F1.0SYM97_ITS1F\|451 | 1655 | F1.0UDYN_ITS1F\|628 | | | | | | | | | | | | | 30 | 27 | 22 | 14 | | | | | | | | |
| 3702 | 1573 | F1.0SYM97_ITS1F\|60 | 1557 | F1.0UDYN_ITS1F\|621 | | | | | | | | | | | | | 25 | 24 | 19 | 11 | | | | | | | | |
| 3707 | 1515 | F1.0SYM97_ITS1F\|31 | 1690 | F1.0SYM97_ITS1F\|463 | | | | | | | | | | | | | 33 | 16 | 15 | 9 | | | | | | | | |
| 3715 | 1682 | F1.0SYM97_ITS1F\|74 | 1681 | F1.0UDYN_ITS1F\|75 | | | | | | | | | | | | | 29 | 19 | 17 | 10 | | | | | | | | |
| 3722 | 1481 | F1.0SYM97_ITS1F\|548 | 1655 | F1.0UDYN_ITS1F\|628 | | | | | | | | | | | | | 11 | 27 | 11 | 5 | | | | | | | | |
| 3723 | 1673 | F1.0SYM97_ITS1F\|122 | 1681 | F1.0SYM97_ITS1F\|75 | | | | | | | | | | | | | 26 | 19 | 17 | 9 | | | | | | | | |
| 3725 | 1673 | F1.0SYM97_ITS1F\|122 | 1605 | F1.0UDYN_ITS1F\|6 | | | | | | | | | | | | | 26 | 27 | 22 | 12 | 26 | 26 | 22 | 18 | | | | |
| 3728 | 1673 | F1.0SYM97_ITS1F\|122 | 1521 | F1.0UDYN_ITS1F\|73 | | | | | | | | | | | | | 26 | 23 | 19 | 11 | | | | | | | | |
| 3729 | 1515 | F1.0SYM97_ITS1F\|31 | 1605 | F1.0UDYN_ITS1F\|6 | | | | | | | | | | | | | 33 | 23 | 25 | 16 | | | | | | | | |
| 3730 | 1515 | F1.0SYM97_ITS1F\|31 | 1521 | F1.0UDYN_ITS1F\|73 | | | | | | | | | | | | | 33 | 23 | 20 | 13 | | | | | | | | |
| 3732 | 1683 | F1.0SYM97_ITS1F\|51 | 1605 | F1.0UDYN_ITS1F\|6 | | | | | | | | | | | | | 26 | 21 | 22 | 12 | | | | | | | | |
| 3733 | 1683 | F1.0SYM97_ITS1F\|51 | 1521 | F1.0UDYN_ITS1F\|73 | | | | | | | | | | | | | 26 | 23 | 21 | 12 | | | | | | | | |
| 3734 | 1682 | F1.0SYM97_ITS1F\|74 | 1574 | F1.0U97_ITS1F\|479 | | | | | | | | | | | | | 29 | 19 | 19 | 13 | | | | | | | | |
| 3735 | 1682 | F1.0SYM97_ITS1F\|74 | 1573 | F1.0UDYN_ITS1F\|60 | | | | | | | | | | | | | 29 | 25 | 19 | 13 | | | | | | | | |
| 3736 | 1682 | F1.0SYM97_ITS1F\|74 | 1521 | F1.0UDYN_ITS1F\|73 | | | | | | | | | | | | | 29 | 23 | 19 | 12 | | | | | | | | |
| 3737 | 1681 | F1.0SYM97_ITS1F\|75 | 1605 | F1.0UDYN_ITS1F\|6 | | | | | | | | | | | | | 19 | 27 | 19 | 9 | | | | | | | | |
| 3738 | 1681 | F1.0SYM97_ITS1F\|75 | 1521 | F1.0UDYN_ITS1F\|73 | | | | | | | | | | | | | 19 | 23 | 15 | 8 | 19 | 22 | 15 | 11 | | | | |
| 3739 | 1576 | F1.0U97_ITS1F\|1112 | 1521 | F1.0UDYN_ITS1F\|1112 | | | | | | | | | | | | | 13 | 17 | 12 | 4 | 12 | 16 | 11 | 5 | | | | |
| 3740 | 1591 | F1.0U97_ITS1F\|3 | 1523 | F1.0UDYN_ITS1F\|486 | | | | | | | | | | | | | 9 | 9 | 8 | 1 | | | | | | | | |
| 3741 | 1591 | F1.0U97_ITS1F\|3 | 1591 | F1.0UDYN_ITS1F\|3 | | | | | | | | | | | | | 9 | 9 | 9 | 1 | | | | | | | | |
| 3742 | 1595 | F1.0U97_ITS1F\|38 | 1595 | F1.0UDYN_ITS1F\|38 | | | | | | | | | | | | | 16 | 12 | 11 | 3 | 15 | 12 | 11 | 5 | | | | |
| 3743 | 1595 | F1.0U97_ITS1F\|38 | 1605 | F1.0UDYN_ITS1F\|6 | | | | | | | | | | | | | 16 | 27 | 15 | 8 | | | | | | | | |
| 3745 | 1523 | F1.0U97_ITS1F\|486 | 1591 | F1.0UDYN_ITS1F\|3 | | | | | | | | | | | | | 9 | 9 | 8 | 1 | | | | | | | | |
| 3746 | 1591 | F1.0U97_ITS1F\|3 | 1523 | F1.0UDYN_ITS1F\|486 | | | | | | | | | | | | | 9 | 9 | 8 | 1 | 9 | 9 | 8 | 4 | 8 | 8 | 8 | 4 |
| 3749 | 1575 | F1.0U97_ITS1F\|37 | 1605 | F1.0UDYN_ITS1F\|6 | | | | | | | | | | | | | 29 | 27 | 22 | 13 | | | | | | | | |
| 3750 | 1575 | F1.0U97_ITS1F\|37 | 1521 | F1.0UDYN_ITS1F\|73 | | | | | | | | | | | | | 19 | 24 | 14 | 8 | | | | | | | | |
| 3754 | 1545 | F1.0SYM97_ITS1F\|516 | 1557 | F1.0UDYN_ITS1F\|621 | | | | | | | | | | | | | 27 | 23 | 18 | 11 | | | | | 9 | 8 | 8 | 4 |
| 3756 | 1605 | F1.0U97_ITS1F\|6 | 1521 | F1.0UDYN_ITS1F\|73 | | | | | | | | | | | | | 9 | 9 | 8 | 1 | | | | | | | | |
| 3765 | 1591 | F1.0U97_ITS1F\|3 | 1523 | F1.0UDYN_ITS1F\|486 | | | | | | | | | | | | | 9 | 9 | 8 | 1 | 8 | 9 | 9 | 4 | | | | |
| 3770 | 1597 | F1.0U97_ITS1F\|22 | 1537 | F1.0UDYN_ITS1F\|129 | | | | | | | | | | | | | 19 | 14 | 11 | 5 | 19 | 14 | 11 | 7 | 8 | 8 | 9 | 4 |
| 3771 | 1681 | F1.0SYM97_ITS1F\|75 | 1576 | F1.0U97_ITS1F\|1112 | | | | | | | | | | | | | 19 | 13 | 10 | 4 | 19 | 12 | 10 | 6 | 5 | 8 | 8 | 3 |
| 3772 | 1531 | F1.0SYM97_ITS1F\|12 | 1531 | F1.0UDYN_ITS1F\|12 | | | | | | | | | | | | | 15 | 15 | 12 | 4 | 11 | 13 | 10 | 4 | 5 | 8 | 8 | |
| 3773 | 1609 | F1.0U97_ITS1F\|30 | 1648 | F1.0UDYN_ITS1F\|409 | | | | | | | | | | | | | | | | | 6 | 7 | 5 | 1 | | | | |
| 3774 | 1491 | F1.0U97_ITS1F\|407 | 1550 | F1.0UDYN_ITS1F\|30 | | | | | | | | | | | | | | | | | 7 | 9 | 6 | 2 | | | | |
| 3775 | 1591 | F1.0U97_ITS1F\|3 | 1690 | F1.0UDYN_ITS1F\|463 | | | | | | | | | | | | | 11 | 16 | 10 | 3 | 11 | 16 | 10 | 5 | | | | |
| 3776 | 1591 | F1.0U97_ITS1F\|3 | 1505 | F1.0UDYN_ITS1F\|185 | | | | | | | | | | | | | | | | | 8 | 4 | 4 | 2 | | | | |
| 3777 | 1493 | F1.0U97_ITS1F\|378 | 1481 | F1.0UDYN_ITS1F\|548 | | | | | | | | | | | | | | | | | 5 | 10 | 5 | 3 | | | | |
| 3778 | 1493 | F1.0U97_ITS1F\|378 | 1630 | F1.0UDYN_ITS1F\|68 | | | | | | | | | | | | | | | | | 5 | 4 | 3 | 1 | | | | |

TABLE 14-continued

| A PAIR | B Endophyte 1 (SEQ ID) | C Endophyte 1 (OTU) | D Endophyte 2 (SEQ ID) | E Endophyte 2 (OTU) | F Bacteria - dicots | | | | G Bacteria - dicots, roots | | | | H Bacteria - dicots, seeds | | | | I Fungi - dicots | | | | J Fungi - dicots, roots | | | | K Fungi - dicots, seeds | | | |
|---|---|---|---|---|---|---|---|---|---|---|---|---|---|---|---|---|---|---|---|---|---|---|---|---|---|---|---|---|
| | | | | | N1 | N2 | OC | EC | N1 | N2 | OC | EC | N1 | N2 | OC | EC | N1 | N2 | OC | EC | N1 | N2 | OC | EC | N1 | N2 | OC | EC |
| 3779 | 1523 | F1.0U97_ITS1F\|486 | 1505 | F1.0UDYN_ITS1F\|185 | | | | | | | | | | | | | | | | | | | | | 9 | 4 | 4 | 2 |
| 3780 | 1523 | F1.0U97_ITS1F\|486 | 1612 | F1.0UDYN_ITS1F\|483 | | | | | | | | | | | | | | | | | | | | | 9 | 4 | 4 | 2 |
| 3781 | 1523 | F1.0U97_ITS1F\|486 | 1523 | F1.0UDYN_ITS1F\|486 | | | | | | | | | | | | | | 9 | 9 | 1 | | | | | 9 | 9 | 9 | 4 |
| 3782 | 1505 | F1.0UDYN_ITS1F\|185 | 1591 | F1.0UDYN_ITS1F\|3 | | | | | | | | | | | | | | | | | | | | | 4 | 8 | 4 | 2 |
| 3783 | 1612 | F1.0UDYN_ITS1F\|185 | 1523 | F1.0UDYN_ITS1F\|486 | | | | | | | | | | | | | | | | | | | | | 4 | 9 | 4 | 2 |
| 3784 | 1481 | F1.0UDYN_ITS1F\|483 | 1523 | F1.0UDYN_ITS1F\|486 | | | | | | | | | | | | | | | | | | | | | 4 | 9 | 4 | 2 |
| 3785 | 1673 | F1.0UDYN_ITS1F\|548 | 1630 | F1.0UDYN_ITS1F\|68 | | | | | | | | | | | | | | | | | | | | | 10 | 4 | 4 | 2 |
| 3786 | 1673 | F1.0SYM97_ITS1F\|122 | 1597 | F1.0SYM97_ITS1F\|22 | | | | | | | | | | | | | | 26 | 19 | 15 | 9 | | | | | | | | |
| 3787 | 1673 | F1.0SYM97_ITS1F\|122 | 1595 | F1.0U97_ITS1F\|38 | | | | | | | | | | | | | | 26 | 16 | 13 | 7 | | | | | | | | |
| 3788 | 1673 | F1.0SYM97_ITS1F\|122 | 1574 | F1.0U97_ITS1F\|479 | | | | | | | | | | | | | | 26 | 26 | 18 | 12 | | | | | | | | |
| 3789 | 1597 | F1.0SYM97_ITS1F\|22 | 1515 | F1.0SYM97_ITS1F\|31 | | | | | | | | | | | | | | 19 | 33 | 18 | 11 | | | | | | | | |
| 3790 | 1597 | F1.0SYM97_ITS1F\|22 | 1683 | F1.0SYM97_ITS1F\|51 | | | | | | | | | | | | | | 19 | 26 | 15 | 9 | | | | | | | | |
| 3791 | 1597 | F1.0SYM97_ITS1F\|22 | 1682 | F1.0SYM97_ITS1F\|74 | | | | | | | | | | | | | | 19 | 29 | 18 | 10 | | | | | | | | |
| 3792 | 1597 | F1.0SYM97_ITS1F\|22 | 1574 | F1.0U97_ITS1F\|479 | | | | | | | | | | | | | | 19 | 26 | 15 | 9 | | | | | | | | |
| 3793 | 1597 | F1.0SYM97_ITS1F\|22 | 1575 | F1.0SYM97_ITS1F\|37 | | | | | | | | | | | | | | 19 | 29 | 17 | 10 | | | | | | | | |
| 3794 | 1597 | F1.0SYM97_ITS1F\|22 | 1605 | F1.0UDYN_ITS1F\|6 | | | | | | | | | | | | | | 19 | 27 | 15 | 9 | | | | | | | | |
| 3795 | 1597 | F1.0SYM97_ITS1F\|22 | 1573 | F1.0UDYN_ITS1F\|60 | | | | | | | | | | | | | | 19 | 25 | 15 | 8 | | | | | | | | |
| 3796 | 1597 | F1.0SYM97_ITS1F\|22 | 1557 | F1.0UDYN_ITS1F\|621 | | | | | | | | | | | | | | 19 | 24 | 14 | 8 | | | | | | | | |
| 3797 | 1597 | F1.0SYM97_ITS1F\|51 | 1573 | F1.0UDYN_ITS1F\|60 | | | | | | | | | | | | | | 26 | 25 | 18 | 11 | | | | | | | | |
| 3798 | 1683 | F1.0SYM97_ITS1F\|74 | 1605 | F1.0UDYN_ITS1F\|6 | | | | | | | | | | | | | | 29 | 27 | 22 | 14 | | | | | | | | |
| 3799 | 1574 | F1.0U97_ITS1F\|479 | 1605 | F1.0UDYN_ITS1F\|6 | | | | | | | | | | | | | | 26 | 27 | 18 | 12 | | | | | | | | |

Table 15: Pairs of Endophytes Useful for the Present Invention, as Identified by Co-Occurrence Analysis of Various Plant Samples.

Column A shows the pair number. Columns B and C show the SEQ ID NO: and OTU designation for endophyte 1 of a pair. Columns D and E show the SEQ ID NO: and OTU designation for endophyte 2 of a pair. Columns F, G, H, I, J, and K show the number of times microbes belonging to OTU1 occur in a sample (N1), the number of times microbes belonging to OTU2 occur in a sample (N2), the number of times the microbes co-occur in all the plant samples of the collection or a subgroup of those plant samples (OC), and the number of times microbes of those OTUs would be expected to co-occur (EC). In this table, "Bacteria—monocots" represents a co-occurrence analysis using all monocot plant samples of the collection, to identify bacteria that co-occur in these samples. "Bacteria—monocots, roots" represents a co-occurrence analysis using only root samples from the monocot plant samples of the collection, to identify bacteria that co-occur in these samples. "Bacteria—monocots, seeds" represents a co-occurrence analysis using only seed samples from the monocot plant samples of the collection, to identify bacteria that co-occur in these samples. "Fungi—monocots" represents a co-occurrence analysis using all monocot plant samples of the collection, to identify fungi that co-occur in these samples. "Fungi—monocots, roots" represents a co-occurrence analysis using only root samples from the monocot plant samples of the collection, to identify fungi that co-occur in these samples. "Fungi—monocots, seeds" represents a co-occurrence analysis using only seed samples from the monocot plant samples of the collection, to identify fungi that co-occur in these samples.

TABLE 15

| PAIR | B Endophyte 1 (SEQ ID NO:) | C Endophyte 1 (OTU) | D Endophyte 2 (SEQ ID NO:) | E Endophyte 2 (OTU) | F Bacteria - monocots | | | | G Bacteria - monocots, roots | | | | H Bacteria - monocots, seeds | | | | I Fungi - monocots | | | | J Fungi - monocots, roots | | | | K Fungi - monocots, seeds | | | |
|---|---|---|---|---|---|---|---|---|---|---|---|---|---|---|---|---|---|---|---|---|---|---|---|---|---|---|---|---|
| | | | | | N1 | N2 | OC | EC | N1 | N2 | OC | EC | N1 | N2 | OC | EC | N1 | N2 | OC | EC | N1 | N2 | OC | EC | N1 | N2 | OC | EC |
| 1 | 1108 | B1.0\|REF97_V4\|1 | 1110 | B1.0\|REF99_V4\|108549 | 43 | 32 | 29 | 8 | | | | | | | | | | | | | | | | | | | | |
| 2 | 1108 | B1.0\|REF97_V4\|1 | 1080 | B1.0\|REF99_V4\|19 | 43 | 42 | 32 | 11 | | | | | | | | | | | | | | | | | | | | |
| 3 | 1108 | B1.0\|REF97_V4\|1 | 1093 | B1.0\|REF99_V4\|29 | 43 | 43 | 33 | 11 | | | | | | | | | | | | | | | | | | | | |
| 4 | 137 | B1.0\|REF97_V4\|11 | 974 | B1.0\|REF97_V4\|2831 | 36 | 42 | 27 | 9 | | | | | | | | | | | | | | | | | | | | |
| 5 | 137 | B1.0\|REF97_V4\|11 | 916 | B1.0\|REF97_V4\|3675 | 36 | 37 | 25 | 8 | | | | | | | | | | | | | | | | | | | | |
| 6 | 137 | B1.0\|REF97_V4\|11 | 137 | B1.0\|REF99_V4\|11 | 36 | 65 | 34 | 14 | | | | | | | | | | | | | | | | | | | | |
| 7 | 137 | B1.0\|REF97_V4\|11 | 789 | B1.0\|REF99_V4\|2172 | 36 | 52 | 29 | 11 | | | | | | | | | | | | | | | | | | | | |
| 8 | 137 | B1.0\|REF97_V4\|11 | 974 | B1.0\|REF99_V4\|2831 | 36 | 42 | 27 | 9 | | | | | | | | | | | | | | | | | | | | |
| 9 | 137 | B1.0\|REF97_V4\|11 | 916 | B1.0\|REF99_V4\|3675 | 36 | 40 | 26 | 9 | | | | | | | | | | | | | | | | | | | | |
| 10 | 137 | B1.0\|REF97_V4\|11 | 1012 | B1.0\|REF99_V4\|597 | 36 | 39 | 26 | 8 | | | | | | | | | | | | | | | | | | | | |
| 15 | 1191 | B1.0\|REF97_V4\|150716 | 1191 | B1.0\|REF99_V4\|150716 | 30 | 31 | 26 | 6 | | | | | 30 | 30 | 26 | 7 | | | | | | | | | | | | |
| 30 | 974 | B1.0\|REF97_V4\|2831 | 916 | B1.0\|REF99_V4\|3675 | 42 | 37 | 37 | 9 | | | | | | | | | | | | | | | | | | | | |
| 31 | 974 | B1.0\|REF97_V4\|2831 | 837 | B1.0\|REF97_V4\|1720 | 42 | 42 | 37 | 11 | | | | | | | | | | | | | | | | | | | | |
| 33 | 974 | B1.0\|REF97_V4\|2831 | 137 | B1.0\|REF99_V4\|11 | 42 | 65 | 41 | 16 | | | | | | | | | | | | | | | | | | | | |
| 34 | 974 | B1.0\|REF97_V4\|2831 | 884 | B1.0\|REF99_V4\|1164 | 42 | 23 | 23 | 6 | | | | | | | | | | | | | | | | | | | | |
| 35 | 974 | B1.0\|REF97_V4\|2831 | 959 | B1.0\|REF99_V4\|126 | 42 | 39 | 39 | 10 | | | | | | | | | | | | | | | | | | | | |
| 36 | 974 | B1.0\|REF97_V4\|2831 | 71 | B1.0\|REF99_V4\|1351 | 42 | 36 | 34 | 9 | | | | | | | | | | | | | | | | | | | | |
| 37 | 974 | B1.0\|REF97_V4\|2831 | 116 | B1.0\|REF99_V4\|1567 | 42 | 39 | 35 | 10 | | | | | | | | | | | | | | | | | | | | |
| 40 | 974 | B1.0\|REF97_V4\|2831 | 1171 | B1.0\|REF99_V4\|1639 | 42 | 27 | 27 | 7 | | | | | | | | | | | | | | | | | | | | |
| 41 | 974 | B1.0\|REF97_V4\|2831 | 889 | B1.0\|REF99_V4\|185 | 42 | 35 | 28 | 9 | | | | | | | | | | | | | | | | | | | | |
| 43 | 974 | B1.0\|REF97_V4\|2831 | 1011 | B1.0\|REF99_V4\|2104 | 42 | 30 | 30 | 8 | | | | | | | | | | | | | | | | | | | | |
| 45 | 974 | B1.0\|REF97_V4\|2831 | 789 | B1.0\|REF99_V4\|2172 | 42 | 52 | 39 | 13 | | | | | | | | | | | | | | | | | | | | |
| 46 | 974 | B1.0\|REF97_V4\|2831 | 810 | B1.0\|REF99_V4\|250 | 42 | 35 | 35 | 9 | | | | | | | | | | | | | | | | | | | | |
| 48 | 974 | B1.0\|REF97_V4\|2831 | 131 | B1.0\|REF99_V4\|251 | 42 | 33 | 26 | 8 | | | | | | | | | | | | | | | | | | | | |
| 49 | 974 | B1.0\|REF97_V4\|2831 | 943 | B1.0\|REF99_V4\|26030 | 42 | 33 | 33 | 8 | | | | | | | | | | | | | | | | | | | | |
| 50 | 974 | B1.0\|REF97_V4\|2831 | 974 | B1.0\|REF99_V4\|2831 | 42 | 42 | 42 | 11 | | | | | | | | | | | | | | | | | | | | |
| 51 | 974 | B1.0\|REF97_V4\|2831 | 615 | B1.0\|REF99_V4\|3374 | 42 | 32 | 32 | 8 | | | | | | | | | | | | | | | | | | | | |
| 52 | 974 | B1.0\|REF97_V4\|2831 | 916 | B1.0\|REF99_V4\|3675 | 42 | 40 | 40 | 10 | | | | | | | | | | | | | | | | | | | | |
| 55 | 974 | B1.0\|REF97_V4\|2831 | 880 | B1.0\|REF99_V4\|472 | 42 | 33 | 33 | 11 | | | | | | | | | | | | | | | | | | | | |
| 57 | 974 | B1.0\|REF97_V4\|2831 | 1012 | B1.0\|REF99_V4\|597 | 42 | 39 | 39 | 10 | | | | | | | | | | | | | | | | | | | | |
| 60 | 974 | B1.0\|REF97_V4\|2831 | 837 | B1.0\|REF99_V4\|1720 | 42 | 67 | 42 | 17 | | | | | | | | | | | | | | | | | | | | |
| 62 | 974 | B1.0\|REF97_V4\|2831 | 713 | B1.0\|REF99_V4\|1754 | 42 | 39 | 30 | 10 | | | | | | | | | | | | | | | | | | | | |
| 63 | 974 | B1.0\|REF97_V4\|2831 | 1007 | B1.0\|REF99_V4\|9526 | 42 | 44 | 38 | 11 | | | | | | | | | | | | | | | | | | | | |
| 65 | 916 | B1.0\|REF97_V4\|3675 | 837 | B1.0\|REF97_V4\|1720 | 42 | 42 | 33 | 9 | | | | | | | | | | | | | | | | | | | | |
| 74 | 916 | B1.0\|REF97_V4\|3675 | 137 | B1.0\|REF99_V4\|11 | 37 | 65 | 36 | 14 | | | | | | | | | | | | | | | | | | | | |
| 76 | 916 | B1.0\|REF97_V4\|3675 | 959 | B1.0\|REF99_V4\|126 | 37 | 39 | 35 | 9 | | | | | | | | | | | | | | | | | | | | |
| 78 | 916 | B1.0\|REF97_V4\|3675 | 71 | B1.0\|REF99_V4\|1351 | 37 | 36 | 30 | 8 | | | | | | | | | | | | | | | | | | | | |
| 80 | 916 | B1.0\|REF97_V4\|3675 | 116 | B1.0\|REF99_V4\|1567 | 37 | 39 | 32 | 9 | | | | | | | | | | | | | | | | | | | | |
| 82 | 916 | B1.0\|REF97_V4\|3675 | 1171 | B1.0\|REF99_V4\|1639 | 37 | 27 | 25 | 6 | | | | | | | | | | | | | | | | | | | | |
| 83 | 916 | B1.0\|REF97_V4\|3675 | 1011 | B1.0\|REF99_V4\|2104 | 37 | 30 | 29 | 7 | | | | | | | | | | | | | | | | | | | | |
| 85 | 916 | B1.0\|REF97_V4\|3675 | 789 | B1.0\|REF99_V4\|2172 | 37 | 52 | 35 | 12 | | | | | | | | | | | | | | | | | | | | |
| 86 | 916 | B1.0\|REF97_V4\|3675 | 810 | B1.0\|REF99_V4\|250 | 37 | 35 | 31 | 8 | | | | | | | | | | | | | | | | | | | | |
| 87 | 916 | B1.0\|REF97_V4\|3675 | 943 | B1.0\|REF99_V4\|26030 | 37 | 33 | 32 | 7 | | | | | | | | | | | | | | | | | | | | |
| 89 | 916 | B1.0\|REF97_V4\|3675 | 974 | B1.0\|REF99_V4\|2831 | 37 | 42 | 37 | 9 | | | | | | | | | | | | | | | | | | | | |
| 90 | 916 | B1.0\|REF97_V4\|3675 | 615 | B1.0\|REF99_V4\|3374 | 37 | 32 | 28 | 7 | | | | | | | | | | | | | | | | | | | | |
| 91 | 916 | B1.0\|REF97_V4\|3675 | 615 | B1.0\|REF99_V4\|3675 | 37 | | | | | | | | | | | | | | | | | | | | | | | |

TABLE 15-continued

| A | B | C | D | E | F Bacteria - monocots | | | | G Bacteria - monocots, roots | | | | H Bacteria - monocots, seeds | | | | I Fungi - monocots | | | | J Fungi - monocots, roots | | | | K Fungi - monocots, seeds | | | |
|---|---|---|---|---|---|---|---|---|---|---|---|---|---|---|---|---|---|---|---|---|---|---|---|---|---|---|---|---|
| PAIR | Endophyte 1 (SEQ ID NO:) | Endophyte 1 (OTU) | Endophyte 2 (SEQ ID NO:) | Endophyte 2 (OTU) | N1 | N2 | OC | EC | N1 | N2 | OC | EC | N1 | N2 | OC | EC | N1 | N2 | OC | EC | N1 | N2 | OC | EC | N1 | N2 | OC | EC |
| 93 | 916 | B1.0iREF97_V4|3675 | 916 | B1.0iREF97_V4|3675 | 37 | 40 | 37 | 9 | | | | | | | | | | | | | | | | | | | | |
| 95 | 916 | B1.0iREF97_V4|3675 | 880 | B1.0iREF99_V4|472 | 37 | 42 | 29 | 9 | | | | | | | | | | | | | | | | | | | | |
| 97 | 916 | B1.0iREF97_V4|3675 | 1012 | B1.0iREF99_V4|597 | 37 | 39 | 34 | 9 | | | | | | | | | | | | | | | | | | | | |
| 99 | 916 | B1.0iREF97_V4|3675 | 837 | B1.0iREF99_V4|4720 | 37 | 67 | 37 | 15 | | | | | | | | | | | | | | | | | | | | |
| 100 | 916 | B1.0iREF97_V4|3675 | 713 | B1.0iREF99_V4|4754 | 37 | 39 | 26 | 9 | | | | | | | | | | | | | | | | | | | | |
| 102 | 916 | B1.0iREF97_V4|3675 | 1007 | B1.0iREF99_V4|9526 | 37 | 44 | 34 | 10 | | | | | | | | | | | | | | | | | | | | |
| 104 | 1106 | B1.0iREF97_V4|466 | 1090 | B1.0iREF99_V4|79117 | 86 | 72 | 63 | 37 | | | | | 57 | 58 | 49 | 26 | | | | | | | | | | | | |
| 106 | 837 | B1.0iREF97_V4|4720 | 137 | B1.0iREF99_V4|11 | 42 | 65 | 36 | 16 | | | | | | | | | | | | | | | | | | | | |
| 107 | 837 | B1.0iREF97_V4|4720 | 884 | B1.0iREF99_V4|11164 | 42 | 23 | 23 | 6 | | | | | | | | | | | | | | | | | | | | |
| 108 | 837 | B1.0iREF97_V4|4720 | 959 | B1.0iREF99_V4|4126 | 42 | 39 | 34 | 10 | | | | | | | | | | | | | | | | | | | | |
| 109 | 837 | B1.0iREF97_V4|4720 | 71 | B1.0iREF99_V4|11351 | 42 | 36 | 29 | 9 | | | | | | | | | | | | | | | | | | | | |
| 110 | 837 | B1.0iREF97_V4|4720 | 116 | B1.0iREF99_V4|11567 | 42 | 30 | 30 | 10 | | | | | | | | | | | | | | | | | | | | |
| 111 | 837 | B1.0iREF97_V4|4720 | 1011 | B1.0iREF99_V4|12104 | 42 | 39 | 25 | 8 | | | | | | | | | | | | | | | | | | | | |
| 112 | 837 | B1.0iREF97_V4|4720 | 789 | B1.0iREF99_V4|12172 | 42 | 52 | 34 | 13 | | | | | | | | | | | | | | | | | | | | |
| 113 | 837 | B1.0iREF97_V4|4720 | 810 | B1.0iREF99_V4|4250 | 42 | 35 | 33 | 9 | | | | | | | | | | | | | | | | | | | | |
| 114 | 837 | B1.0iREF97_V4|4720 | 943 | B1.0iREF99_V4|26030 | 42 | 33 | 29 | 8 | | | | | | | | | | | | | | | | | | | | |
| 115 | 837 | B1.0iREF97_V4|4720 | 974 | B1.0iREF99_V4|2831 | 42 | 39 | 37 | 11 | | | | | | | | | | | | | | | | | | | | |
| 116 | 837 | B1.0iREF97_V4|4720 | 615 | B1.0iREF99_V4|13374 | 42 | 32 | 28 | 8 | | | | | | | | | | | | | | | | | | | | |
| 118 | 837 | B1.0iREF97_V4|4720 | 916 | B1.0iREF99_V4|3675 | 42 | 40 | 35 | 10 | | | | | | | | | | | | | | | | | | | | |
| 119 | 837 | B1.0iREF97_V4|4720 | 880 | B1.0iREF99_V4|472 | 42 | 29 | 29 | 11 | | | | | | | | | | | | | | | | | | | | |
| 120 | 837 | B1.0iREF97_V4|4720 | 1012 | B1.0iREF99_V4|597 | 42 | 39 | 35 | 10 | | | | | | | | | | | | | | | | | | | | |
| 121 | 837 | B1.0iREF97_V4|4720 | 837 | B1.0iREF99_V4|4720 | 42 | 67 | 42 | 17 | | | | | | | | | | | | | | | | | | | | |
| 124 | 837 | B1.0iREF97_V4|4720 | 1007 | B1.0iREF99_V4|9526 | 42 | 44 | 33 | 11 | | | | | | | | | | | | | | | | | | | | |
| 125 | 837 | B1.0iREF97_V4|4720 | 510 | B1.0iREF99_V4|8981 | 28 | 33 | 27 | 6 | | | | | 26 | 27 | 25 | 6 | | | | | | | | | | | | |
| 139 | 372 | B1.0iREF99_V4|10206 | 881 | B1.0iREF99_V4|4434 | 83 | 74 | 56 | 37 | | | | | | | | | | | | | | | | | | | | |
| 140 | 1110 | B1.0iREF99_V4|108549 | 1081 | B1.0iREF99_V4|156009 | 32 | 48 | 31 | 9 | | | | | 32 | 48 | 31 | 12 | | | | | | | | | | | | |
| 141 | 1110 | B1.0iREF99_V4|108549 | 1097 | B1.0iREF99_V4|159716 | 32 | 30 | 27 | 6 | | | | | 32 | 30 | 27 | 8 | | | | | | | | | | | | |
| 142 | 1110 | B1.0iREF99_V4|108549 | 1080 | B1.0iREF99_V4|419 | 32 | 42 | 30 | 8 | | | | | 32 | 39 | 30 | 10 | | | | | | | | | | | | |
| 143 | 1110 | B1.0iREF99_V4|108549 | 1086 | B1.0iREF99_V4|25794 | 32 | 52 | 30 | 10 | | | | | 32 | 52 | 30 | 13 | | | | | | | | | | | | |
| 144 | 1110 | B1.0iREF99_V4|108549 | 1093 | B1.0iREF99_V4|429 | 32 | 43 | 30 | 13 | | | | | 32 | 39 | 29 | 10 | | | | | | | | | | | | |
| 146 | 137 | B1.0iREF99_V4|11 | 959 | B1.0iREF99_V4|4126 | 65 | 39 | 38 | 15 | | | | | | | | | | | | | | | | | | | | |
| 147 | 137 | B1.0iREF99_V4|11 | 71 | B1.0iREF99_V4|11351 | 65 | 36 | 33 | 14 | | | | | | | | | | | | | | | | | | | | |
| 148 | 137 | B1.0iREF99_V4|11 | 116 | B1.0iREF99_V4|11567 | 65 | 39 | 36 | 15 | | | | | | | | | | | | | | | | | | | | |
| 151 | 137 | B1.0iREF99_V4|11 | 1011 | B1.0iREF99_V4|12104 | 65 | 30 | 29 | 12 | | | | | | | | | | | | | | | | | | | | |
| 152 | 137 | B1.0iREF99_V4|11 | 789 | B1.0iREF99_V4|12172 | 65 | 52 | 42 | 20 | | | | | | | | | | | | | | | | | | | | |
| 153 | 137 | B1.0iREF99_V4|11 | 810 | B1.0iREF99_V4|4250 | 65 | 35 | 34 | 14 | | | | | | | | | | | | | | | | | | | | |
| 154 | 137 | B1.0iREF99_V4|11 | 943 | B1.0iREF99_V4|26030 | 65 | 33 | 32 | 13 | | | | | | | | | | | | | | | | | | | | |
| 155 | 137 | B1.0iREF99_V4|11 | 974 | B1.0iREF99_V4|2831 | 65 | 42 | 31 | 12 | | | | | | | | | | | | | | | | | | | | |
| 156 | 137 | B1.0iREF99_V4|11 | 615 | B1.0iREF99_V4|13374 | 65 | 32 | 31 | 12 | | | | | | | | | | | | | | | | | | | | |
| 158 | 137 | B1.0iREF99_V4|11 | 916 | B1.0iREF99_V4|3675 | 65 | 40 | 39 | 16 | | | | | | | | | | | | | | | | | | | | |
| 159 | 137 | B1.0iREF99_V4|11 | 880 | B1.0iREF99_V4|472 | 65 | 39 | 39 | 16 | | | | | | | | | | | | | | | | | | | | |
| 161 | 137 | B1.0iREF99_V4|11 | 1012 | B1.0iREF99_V4|597 | 65 | 42 | 39 | 15 | | | | | | | | | | | | | | | | | | | | |
| 162 | 137 | B1.0iREF99_V4|11 | 837 | B1.0iREF99_V4|4720 | 65 | 67 | 48 | 26 | | | | | | | | | | | | | | | | | | | | |
| 163 | 137 | B1.0iREF99_V4|11 | 713 | B1.0iREF99_V4|4754 | 65 | 39 | 32 | 15 | | | | | | | | | | | | | | | | | | | | |
| 165 | 137 | B1.0iREF99_V4|11 | 1007 | B1.0iREF99_V4|9526 | 65 | 44 | 38 | 17 | | | | | | | | | | | | | | | | | | | | |
| 172 | 884 | B1.0iREF99_V4|11164 | 974 | B1.0iREF99_V4|2831 | 23 | 42 | 23 | 6 | | | | | | | | | | | | | | | | | | | | |
| 179 | 959 | B1.0iREF99_V4|4126 | 71 | B1.0iREF99_V4|11351 | 39 | 36 | 32 | 8 | | | | | | | | | | | | | | | | | | | | |

TABLE 15-continued

| A PAIR | B Endophyte 1 (SEQ ID NO:) | C Endophyte 1 (OTU) | D Endophyte 2 (SEQ ID NO:) | E Endophyte 2 (OTU) | F Bacteria - monocots N1 | | | | G Bacteria - monocots, roots N1 | | | | H Bacteria - monocots, seeds N1 | | | | I Fungi - monocots N1 | | | | J Fungi - monocots, roots N1 | | | | K Fungi - monocots, seeds N1 | | | |
|---|---|---|---|---|---|---|---|---|---|---|---|---|---|---|---|---|---|---|---|---|---|---|---|---|---|---|---|---|---|
| | | | | | N1 | N2 | OC | EC | N1 | N2 | OC | EC | N1 | N2 | OC | EC | N1 | N2 | OC | EC | N1 | N2 | OC | EC | N1 | N2 | OC | EC |
| 181 | 959 | B1.0iREF99_V4\|126 | 116 | B1.0iREF99_V4\|1567 | 39 | 39 | 33 | 9 | | | | | | | | | | | | | | | | | | | | |
| 184 | 959 | B1.0iREF99_V4\|126 | 1011 | B1.0iREF99_V4\|2104 | 39 | 30 | 29 | 7 | | | | | | | | | | | | | | | | | | | | |
| 185 | 959 | B1.0iREF99_V4\|126 | 789 | B1.0iREF99_V4\|2172 | 39 | 52 | 37 | 12 | | | | | | | | | | | | | | | | | | | | |
| 186 | 959 | B1.0iREF99_V4\|126 | 810 | B1.0iREF99_V4\|250 | 39 | 35 | 32 | 8 | | | | | | | | | | | | | | | | | | | | |
| 188 | 959 | B1.0iREF99_V4\|126 | 943 | B1.0iREF99_V4\|26030 | 39 | 33 | 31 | 8 | | | | | | | | | | | | | | | | | | | | |
| 189 | 959 | B1.0iREF99_V4\|126 | 974 | B1.0iREF99_V4\|2831 | 39 | 42 | 39 | 10 | | | | | | | | | | | | | | | | | | | | |
| 190 | 959 | B1.0iREF99_V4\|126 | 615 | B1.0iREF99_V4\|3374 | 39 | 32 | 30 | 7 | | | | | | | | | | | | | | | | | | | | |
| 193 | 959 | B1.0iREF99_V4\|126 | 916 | B1.0iREF99_V4\|3675 | 39 | 40 | 37 | 9 | | | | | | | | | | | | | | | | | | | | |
| 195 | 959 | B1.0iREF99_V4\|126 | 880 | B1.0iREF99_V4\|472 | 39 | 42 | 31 | 10 | | | | | | | | | | | | | | | | | | | | |
| 197 | 959 | B1.0iREF99_V4\|126 | 1012 | B1.0iREF99_V4\|597 | 39 | 39 | 36 | 9 | | | | | | | | | | | | | | | | | | | | |
| 198 | 959 | B1.0iREF99_V4\|126 | 837 | B1.0iREF99_V4\|1720 | 39 | 67 | 39 | 16 | | | | | | | | | | | | | | | | | | | | |
| 199 | 959 | B1.0iREF99_V4\|126 | 713 | B1.0iREF99_V4\|1754 | 39 | 39 | 29 | 9 | | | | | | | | | | | | | | | | | | | | |
| 201 | 959 | B1.0iREF99_V4\|126 | 1007 | B1.0iREF99_V4\|9526 | 39 | 44 | 35 | 10 | | | | | | | | | | | | | | | | | | | | |
| 205 | 71 | B1.0iREF99_V4\|1351 | 116 | B1.0iREF99_V4\|1567 | 36 | 39 | 29 | 8 | | | | | | | | | | | | | | | | | | | | |
| 206 | 71 | B1.0iREF99_V4\|1351 | 1011 | B1.0iREF99_V4\|2104 | 36 | 30 | 25 | 6 | | | | | | | | | | | | | | | | | | | | |
| 207 | 71 | B1.0iREF99_V4\|1351 | 789 | B1.0iREF99_V4\|2172 | 36 | 52 | 32 | 11 | | | | | | | | | | | | | | | | | | | | |
| 208 | 71 | B1.0iREF99_V4\|1351 | 810 | B1.0iREF99_V4\|250 | 36 | 35 | 28 | 8 | | | | | | | | | | | | | | | | | | | | |
| 210 | 71 | B1.0iREF99_V4\|1351 | 943 | B1.0iREF99_V4\|26030 | 36 | 33 | 27 | 7 | | | | | | | | | | | | | | | | | | | | |
| 211 | 71 | B1.0iREF99_V4\|1351 | 974 | B1.0iREF99_V4\|2831 | 36 | 42 | 34 | 9 | | | | | | | | | | | | | | | | | | | | |
| 212 | 71 | B1.0iREF99_V4\|1351 | 615 | B1.0iREF99_V4\|3374 | 36 | 32 | 26 | 7 | | | | | | | | | | | | | | | | | | | | |
| 214 | 71 | B1.0iREF99_V4\|1351 | 916 | B1.0iREF99_V4\|3675 | 36 | 40 | 32 | 9 | | | | | | | | | | | | | | | | | | | | |
| 215 | 71 | B1.0iREF99_V4\|1351 | 880 | B1.0iREF99_V4\|472 | 36 | 42 | 29 | 9 | | | | | | | | | | | | | | | | | | | | |
| 217 | 71 | B1.0iREF99_V4\|1351 | 1012 | B1.0iREF99_V4\|597 | 36 | 39 | 31 | 8 | | | | | | | | | | | | | | | | | | | | |
| 218 | 71 | B1.0iREF99_V4\|1351 | 837 | B1.0iREF99_V4\|1720 | 36 | 67 | 34 | 14 | | | | | | | | | | | | | | | | | | | | |
| 221 | 71 | B1.0iREF99_V4\|1351 | 1007 | B1.0iREF99_V4\|9526 | 36 | 44 | 31 | 9 | | | | | | | | | | | | | | | | | | | | |
| 228 | 1112 | B1.0iREF99_V4\|14460 | 1088 | B1.0iREF99_V4\|11703 | 81 | 62 | 56 | 30 | | | | | 81 | 62 | 56 | 40 | | | | | | | | | | | | |
| 229 | 1112 | B1.0iREF99_V4\|14460 | 1109 | B1.0iREF99_V4\|25629 | 81 | 72 | 71 | 35 | | | | | 81 | 72 | 71 | 46 | | | | | | | | | | | | |
| 232 | 1091 | B1.0iREF99_V4\|15 | 1080 | B1.0iREF99_V4\|419 | 52 | 42 | 33 | 13 | | | | | 45 | 39 | 31 | 14 | | | | | | | | | | | | |
| 234 | 1091 | B1.0iREF99_V4\|15 | 1086 | B1.0iREF99_V4\|25794 | 52 | 52 | 33 | 16 | | | | | 45 | 52 | 33 | 19 | | | | | | | | | | | | |
| 235 | 1091 | B1.0iREF99_V4\|15 | 1093 | B1.0iREF99_V4\|429 | 52 | 43 | 33 | 13 | | | | | 45 | 39 | 31 | 14 | | | | | | | | | | | | |
| 236 | 1191 | B1.0iREF99_V4\|150716 | 972 | B1.0iREF99_V4\|1218 | 48 | 52 | 36 | 15 | | | | | 30 | 37 | 22 | 9 | | | | | | | | | | | | |
| 240 | 1081 | B1.0iREF99_V4\|156009 | 1086 | B1.0iREF99_V4\|25794 | 48 | 43 | 32 | 12 | | | | | 48 | 52 | 36 | 20 | | | | | | | | | | | | |
| 241 | 1081 | B1.0iREF99_V4\|156009 | 1093 | B1.0iREF99_V4\|429 | 48 | 52 | 25 | 7 | | | | | 48 | 39 | 32 | 15 | | | | | | | | | | | | |
| 245 | 116 | B1.0iREF99_V4\|1567 | 1011 | B1.0iREF99_V4\|2104 | 39 | 30 | 34 | 12 | | | | | | | | | | | | | | | | | | | | |
| 246 | 116 | B1.0iREF99_V4\|1567 | 789 | B1.0iREF99_V4\|2172 | 39 | 52 | 29 | 8 | | | | | | | | | | | | | | | | | | | | |
| 247 | 116 | B1.0iREF99_V4\|1567 | 810 | B1.0iREF99_V4\|250 | 39 | 35 | 30 | 8 | | | | | | | | | | | | | | | | | | | | |
| 248 | 116 | B1.0iREF99_V4\|1567 | 943 | B1.0iREF99_V4\|26030 | 39 | 33 | 35 | 10 | | | | | | | | | | | | | | | | | | | | |
| 249 | 116 | B1.0iREF99_V4\|1567 | 974 | B1.0iREF99_V4\|2831 | 39 | 42 | 26 | 7 | | | | | | | | | | | | | | | | | | | | |
| 250 | 116 | B1.0iREF99_V4\|1567 | 615 | B1.0iREF99_V4\|3374 | 39 | 32 | 34 | 9 | | | | | | | | | | | | | | | | | | | | |
| 251 | 116 | B1.0iREF99_V4\|1567 | 916 | B1.0iREF99_V4\|3675 | 39 | 40 | 30 | 10 | | | | | | | | | | | | | | | | | | | | |
| 252 | 116 | B1.0iREF99_V4\|1567 | 880 | B1.0iREF99_V4\|472 | 39 | 42 | 30 | 10 | | | | | | | | | | | | | | | | | | | | |
| 254 | 116 | B1.0iREF99_V4\|1567 | 1012 | B1.0iREF99_V4\|597 | 39 | 39 | 25 | 9 | | | | | | | | | | | | | | | | | | | | |
| 255 | 116 | B1.0iREF99_V4\|1567 | 837 | B1.0iREF99_V4\|1720 | 39 | 67 | 36 | 16 | | | | | | | | | | | | | | | | | | | | |
| 256 | 116 | B1.0iREF99_V4\|1567 | 713 | B1.0iREF99_V4\|1754 | 39 | 39 | 27 | 9 | | | | | | | | | | | | | | | | | | | | |
| 258 | 116 | B1.0iREF99_V4\|1567 | 1007 | B1.0iREF99_V4\|9526 | 39 | 44 | 32 | 10 | | | | | | | | | | | | | | | | | | | | |
| 259 | 1097 | B1.0iREF99_V4\|159716 | 1086 | B1.0iREF99_V4\|25794 | 30 | 52 | 30 | 9 | 27 | 33 | 26 | 21 | 30 | 52 | 30 | 12 | | | | | | | | | | | | |
| 260 | 1171 | B1.0iREF99_V4\|1639 | 943 | B1.0iREF99_V4\|26030 | 27 | 33 | 26 | 5 | | | | | | | | | | | | | | | | | | | | | | |

TABLE 15-continued

| A PAIR | B Endophyte 1 (SEQ ID NO:) | C Endophyte 1 (OTU) | D Endophyte 2 (SEQ ID NO:) | E Endophyte 2 (OTU) | F Bacteria - monocots N1 | N2 | OC | EC | G Bacteria - monocots, roots N1 | N2 | OC | EC | H Bacteria - monocots, seeds N1 | N2 | OC | EC | I Fungi - monocots N1 | N2 | OC | EC | J Fungi - monocots, roots N1 | N2 | OC | EC | K Fungi - monocots, seeds N1 | N2 | OC | EC |
|---|---|---|---|---|---|---|---|---|---|---|---|---|---|---|---|---|---|---|---|---|---|---|---|---|---|---|---|---|
| 261 | 1171 | B1.0|REF99_V4|1639 | 974 | B1.0|REF99_V4|2831 | 27 | 42 | 27 | 7 |  |  |  |  |  |  |  |  |  |  |  |  |  |  |  |  |  |  |  |  |
| 262 | 1171 | B1.0|REF99_V4|1639 | 916 | B1.0|REF99_V4|3675 | 27 | 40 | 27 | 6 |  |  |  |  |  |  |  |  |  |  |  |  |  |  |  |  |  |  |  |  |
| 267 | 1088 | B1.0|REF99_V4|1703 | 1109 | B1.0|REF99_V4|25629 | 62 | 72 | 53 | 27 |  |  |  |  | 62 | 72 | 53 | 35 |  |  |  |  |  |  |  |  |  |  |  |  |
| 269 | 889 | B1.0|REF99_V4|4185 | 789 | B1.0|REF99_V4|2172 | 35 | 52 | 29 | 11 |  |  |  |  |  |  |  |  |  |  |  |  |  |  |  |  |  |  |  |  |
| 270 | 889 | B1.0|REF99_V4|4185 | 974 | B1.0|REF99_V4|2831 | 35 | 42 | 28 | 9 |  |  |  |  |  |  |  |  |  |  |  |  |  |  |  |  |  |  |  |  |
| 271 | 889 | B1.0|REF99_V4|4185 | 916 | B1.0|REF99_V4|3675 | 35 | 40 | 27 | 8 |  |  |  |  |  |  |  |  |  |  |  |  |  |  |  |  |  |  |  |  |
| 272 | 889 | B1.0|REF99_V4|4185 | 1012 | B1.0|REF99_V4|597 | 35 | 39 | 25 | 8 |  |  |  |  |  |  |  |  |  |  |  |  |  |  |  |  |  |  |  |  |
| 273 | 1080 | B1.0|REF99_V4|419 | 1086 | B1.0|REF99_V4|25794 | 42 | 52 | 34 | 13 |  |  |  |  | 39 | 52 | 34 | 16 |  |  |  |  |  |  |  |  |  |  |  |  |
| 274 | 1080 | B1.0|REF99_V4|419 | 1093 | B1.0|REF99_V4|429 | 42 | 43 | 32 | 11 |  |  |  |  | 39 | 39 | 29 | 12 |  |  |  |  |  |  |  |  |  |  |  |  |
| 280 | 656 | B1.0|REF99_V4|4191 | 713 | B1.0|REF99_V4|4754 | 43 | 39 | 27 | 10 |  |  |  |  |  |  |  |  |  |  |  |  |  |  |  |  |  |  |  |  |
| 283 | 1195 | B1.0|REF99_V4|41916 | 881 | B1.0|REF99_V4|434 | 51 | 74 | 41 | 23 |  |  |  |  |  |  |  |  |  |  |  |  |  |  |  |  |  |  |  |  |
| 286 | 1011 | B1.0|REF99_V4|42104 | 789 | B1.0|REF99_V4|2172 | 30 | 52 | 29 | 9 |  |  |  |  |  |  |  |  |  |  |  |  |  |  |  |  |  |  |  |  |
| 287 | 1011 | B1.0|REF99_V4|42104 | 810 | B1.0|REF99_V4|4250 | 30 | 35 | 23 | 6 |  |  |  |  |  |  |  |  |  |  |  |  |  |  |  |  |  |  |  |  |
| 289 | 1011 | B1.0|REF99_V4|42104 | 943 | B1.0|REF99_V4|26030 | 30 | 33 | 27 | 6 | 26 | 30 | 25 | 19 |  |  |  |  |  |  |  |  |  |  |  |  |  |  |  |  |
| 290 | 1011 | B1.0|REF99_V4|42104 | 974 | B1.0|REF99_V4|2831 | 30 | 42 | 30 | 8 |  |  |  |  |  |  |  |  |  |  |  |  |  |  |  |  |  |  |  |  |
| 291 | 1011 | B1.0|REF99_V4|42104 | 615 | B1.0|REF99_V4|3374 | 30 | 32 | 25 | 6 |  |  |  |  |  |  |  |  |  |  |  |  |  |  |  |  |  |  |  |  |
| 293 | 1011 | B1.0|REF99_V4|42104 | 916 | B1.0|REF99_V4|3675 | 30 | 40 | 30 | 7 |  |  |  |  |  |  |  |  |  |  |  |  |  |  |  |  |  |  |  |  |
| 294 | 1011 | B1.0|REF99_V4|42104 | 880 | B1.0|REF99_V4|4472 | 30 | 42 | 25 | 8 |  |  |  |  |  |  |  |  |  |  |  |  |  |  |  |  |  |  |  |  |
| 296 | 1011 | B1.0|REF99_V4|42104 | 1012 | B1.0|REF99_V4|597 | 30 | 39 | 27 | 7 |  |  |  |  |  |  |  |  |  |  |  |  |  |  |  |  |  |  |  |  |
| 297 | 1011 | B1.0|REF99_V4|42104 | 837 | B1.0|REF99_V4|9526 | 30 | 67 | 30 | 12 |  |  |  |  |  |  |  |  |  |  |  |  |  |  |  |  |  |  |  |  |
| 300 | 1011 | B1.0|REF99_V4|42104 | 1007 | B1.0|REF99_V4|26030 | 30 | 44 | 28 | 8 |  |  |  |  |  |  |  |  |  |  |  |  |  |  |  |  |  |  |  |  |
| 301 | 789 | B1.0|REF99_V4|42172 | 810 | B1.0|REF99_V4|4250 | 52 | 35 | 32 | 11 |  |  |  |  |  |  |  |  |  |  |  |  |  |  |  |  |  |  |  |  |
| 303 | 789 | B1.0|REF99_V4|42172 | 943 | B1.0|REF99_V4|26030 | 52 | 33 | 33 | 10 |  |  |  |  |  |  |  |  |  |  |  |  |  |  |  |  |  |  |  |  |
| 304 | 789 | B1.0|REF99_V4|42172 | 974 | B1.0|REF99_V4|2831 | 52 | 42 | 39 | 13 |  |  |  |  |  |  |  |  |  |  |  |  |  |  |  |  |  |  |  |  |
| 305 | 789 | B1.0|REF99_V4|42172 | 615 | B1.0|REF99_V4|3374 | 52 | 32 | 30 | 10 |  |  |  |  |  |  |  |  |  |  |  |  |  |  |  |  |  |  |  |  |
| 307 | 789 | B1.0|REF99_V4|42172 | 916 | B1.0|REF99_V4|3675 | 52 | 40 | 37 | 12 |  |  |  |  |  |  |  |  |  |  |  |  |  |  |  |  |  |  |  |  |
| 308 | 789 | B1.0|REF99_V4|42172 | 880 | B1.0|REF99_V4|4472 | 52 | 42 | 32 | 13 |  |  |  |  |  |  |  |  |  |  |  |  |  |  |  |  |  |  |  |  |
| 310 | 789 | B1.0|REF99_V4|42172 | 1012 | B1.0|REF99_V4|597 | 52 | 39 | 36 | 12 |  |  |  |  |  |  |  |  |  |  |  |  |  |  |  |  |  |  |  |  |
| 311 | 789 | B1.0|REF99_V4|42172 | 837 | B1.0|REF99_V4|9526 | 52 | 67 | 41 | 21 |  |  |  |  |  |  |  |  |  |  |  |  |  |  |  |  |  |  |  |  |
| 312 | 789 | B1.0|REF99_V4|42172 | 1007 | B1.0|REF99_V4|26030 | 52 | 39 | 39 | 12 |  |  |  |  |  |  |  |  |  |  |  |  |  |  |  |  |  |  |  |  |
| 314 | 789 | B1.0|REF99_V4|42172 | 1012 | B1.0|REF99_V4|597 | 52 | 44 | 36 | 14 |  |  |  |  |  |  |  |  |  |  |  |  |  |  |  |  |  |  |  |  |
| 318 | 683 | B1.0|REF99_V4|42385 | 943 | B1.0|REF99_V4|26030 | 22 | 39 | 22 | 5 |  |  |  |  |  |  |  |  |  |  |  |  |  |  |  |  |  |  |  |  |
| 319 | 810 | B1.0|REF99_V4|4250 | 974 | B1.0|REF99_V4|2831 | 35 | 39 | 27 | 7 |  |  |  |  |  |  |  |  |  |  |  |  |  |  |  |  |  |  |  |  |
| 320 | 810 | B1.0|REF99_V4|4250 | 615 | B1.0|REF99_V4|3374 | 35 | 33 | 35 | 9 |  |  |  |  |  |  |  |  |  |  |  |  |  |  |  |  |  |  |  |  |
| 321 | 810 | B1.0|REF99_V4|4250 | 916 | B1.0|REF99_V4|3675 | 35 | 32 | 27 | 7 |  |  |  |  |  |  |  |  |  |  |  |  |  |  |  |  |  |  |  |  |
| 322 | 810 | B1.0|REF99_V4|4250 | 880 | B1.0|REF99_V4|4472 | 35 | 40 | 33 | 8 |  |  |  |  |  |  |  |  |  |  |  |  |  |  |  |  |  |  |  |  |
| 323 | 810 | B1.0|REF99_V4|4250 | 1012 | B1.0|REF99_V4|597 | 35 | 42 | 26 | 9 |  |  |  |  |  |  |  |  |  |  |  |  |  |  |  |  |  |  |  |  |
| 324 | 810 | B1.0|REF99_V4|4250 | 837 | B1.0|REF99_V4|9526 | 35 | 39 | 35 | 8 |  |  |  |  |  |  |  |  |  |  |  |  |  |  |  |  |  |  |  |  |
| 325 | 810 | B1.0|REF99_V4|4250 | 1007 | B1.0|REF99_V4|26030 | 35 | 67 | 35 | 14 |  |  |  |  |  |  |  |  |  |  |  |  |  |  |  |  |  |  |  |  |
| 328 | 810 | B1.0|REF99_V4|4250 | 974 | B1.0|REF99_V4|2831 | 35 | 44 | 32 | 9 |  |  |  |  |  |  |  |  |  |  |  |  |  |  |  |  |  |  |  |  |
| 329 | 131 | B1.0|REF99_V4|4251 | 1093 | B1.0|REF99_V4|429 | 33 | 42 | 26 | 8 |  |  |  |  |  |  |  |  |  |  |  |  |  |  |  |  |  |  |  |  |
| 337 | 1086 | B1.0|REF99_V4|25794 | 974 | B1.0|REF99_V4|2831 | 52 | 43 | 31 | 13 |  |  |  |  | 52 | 39 | 31 | 16 |  |  |  |  |  |  |  |  |  |  |  |  |
| 338 | 943 | B1.0|REF99_V4|26030 | 615 | B1.0|REF99_V4|3374 | 33 | 42 | 33 | 8 |  |  |  |  |  |  |  |  |  |  |  |  |  |  |  |  |  |  |  |  |
| 339 | 943 | B1.0|REF99_V4|26030 | 916 | B1.0|REF99_V4|3675 | 33 | 32 | 26 | 6 |  |  |  |  |  |  |  |  |  |  |  |  |  |  |  |  |  |  |  |  |
| 341 | 943 | B1.0|REF99_V4|26030 | 880 | B1.0|REF99_V4|4472 | 33 | 40 | 33 | 8 |  |  |  |  |  |  |  |  |  |  |  |  |  |  |  |  |  |  |  |  |
| 342 | 943 | B1.0|REF99_V4|26030 | 1012 | B1.0|REF99_V4|597 | 33 | 42 | 27 | 8 |  |  |  |  |  |  |  |  |  |  |  |  |  |  |  |  |  |  |  |  |
| 344 | 943 | B1.0|REF99_V4|26030 | 837 | B1.0|REF99_V4|9526 | 33 | 39 | 30 | 8 |  |  |  |  |  |  |  |  |  |  |  |  |  |  |  |  |  |  |  |  |

TABLE 15-continued

| A PAIR | B Endophyte 1 (SEQ ID NO:) | C Endophyte 1 (OTU) | D Endophyte 2 (SEQ ID NO:) | E Endophyte 2 (OTU) | F Bacteria - monocots N1 | F N2 | F OC | F EC | G Bacteria - monocots, roots N1 | G N2 | G OC | G EC | H Bacteria - monocots, seeds N1 | H N2 | H OC | H EC | I Fungi - monocots N1 | I N2 | I OC | I EC | J Fungi - monocots, roots N1 | J N2 | J OC | J EC | K Fungi - monocots, seeds N1 | K N2 | K OC | K EC |
|---|---|---|---|---|---|---|---|---|---|---|---|---|---|---|---|---|---|---|---|---|---|---|---|---|---|---|---|---|
| 345 | 943 | B1.0\|REF99_V4\|26030 | 837 | B1.0\|REF99_V4\|720 | 33 | 67 | 33 | 13 | | | | | | | | | | | | | | | | | | | | |
| 348 | 943 | B1.0\|REF99_V4\|26030 | 1007 | B1.0\|REF99_V4\|9526 | 33 | 44 | 31 | 9 | | | | | | | | | | | | | | | | | | | | |
| 349 | 974 | B1.0\|REF99_V4\|2831 | 615 | B1.0\|REF99_V4\|3374 | 42 | 32 | 32 | 8 | | | | | | | | | | | | | | | | | | | | |
| 352 | 974 | B1.0\|REF99_V4\|2831 | 916 | B1.0\|REF99_V4\|3675 | 42 | 40 | 40 | 10 | | | | | | | | | | | | | | | | | | | | |
| 354 | 974 | B1.0\|REF99_V4\|2831 | 880 | B1.0\|REF99_V4\|472 | 42 | 42 | 33 | 11 | | | | | | | | | | | | | | | | | | | | |
| 357 | 974 | B1.0\|REF99_V4\|2831 | 1012 | B1.0\|REF99_V4\|597 | 42 | 39 | 39 | 10 | | | | | | | | | | | | | | | | | | | | |
| 359 | 974 | B1.0\|REF99_V4\|2831 | 837 | B1.0\|REF99_V4\|720 | 42 | 67 | 42 | 17 | | | | | | | | | | | | | | | | | | | | |
| 360 | 974 | B1.0\|REF99_V4\|2831 | 713 | B1.0\|REF99_V4\|754 | 42 | 39 | 30 | 10 | | | | | | | | | | | | | | | | | | | | |
| 362 | 974 | B1.0\|REF99_V4\|2831 | 1007 | B1.0\|REF99_V4\|9526 | 42 | 44 | 38 | 10 | | | | | | | | | | | | | | | | | | | | |
| 366 | 615 | B1.0\|REF99_V4\|3374 | 916 | B1.0\|REF99_V4\|3675 | 32 | 40 | 31 | 11 | | | | | | | | | | | | | | | | | | | | |
| 367 | 615 | B1.0\|REF99_V4\|3374 | 880 | B1.0\|REF99_V4\|472 | 32 | 42 | 26 | 8 | | | | | | | | | | | | | | | | | | | | |
| 369 | 615 | B1.0\|REF99_V4\|3374 | 1012 | B1.0\|REF99_V4\|597 | 32 | 39 | 31 | 7 | | | | | | | | | | | | | | | | | | | | |
| 370 | 615 | B1.0\|REF99_V4\|3374 | 837 | B1.0\|REF99_V4\|720 | 32 | 67 | 32 | 13 | | | | | | | | | | | | | | | | | | | | |
| 373 | 615 | B1.0\|REF99_V4\|3374 | 1007 | B1.0\|REF99_V4\|9526 | 32 | 44 | 29 | 8 | | | | | | | | | | | | | | | | | | | | |
| 379 | 916 | B1.0\|REF99_V4\|3675 | 880 | B1.0\|REF99_V4\|472 | 40 | 42 | 31 | 10 | | | | | | | | | | | | | | | | | | | | |
| 381 | 916 | B1.0\|REF99_V4\|3675 | 1012 | B1.0\|REF99_V4\|597 | 40 | 39 | 37 | 9 | | | | | | | | | | | | | | | | | | | | |
| 383 | 916 | B1.0\|REF99_V4\|3675 | 837 | B1.0\|REF99_V4\|720 | 40 | 67 | 40 | 16 | | | | | | | | | | | | | | | | | | | | |
| 384 | 916 | B1.0\|REF99_V4\|3675 | 713 | B1.0\|REF99_V4\|754 | 40 | 39 | 28 | 9 | | | | | | | | | | | | | | | | | | | | |
| 386 | 916 | B1.0\|REF99_V4\|3675 | 1007 | B1.0\|REF99_V4\|9526 | 40 | 44 | 37 | 11 | | | | | | | | | | | | | | | | | | | | |
| 389 | 880 | B1.0\|REF99_V4\|472 | 1012 | B1.0\|REF99_V4\|597 | 42 | 39 | 30 | 10 | | | | | | | | | | | | | | | | | | | | |
| 390 | 880 | B1.0\|REF99_V4\|472 | 837 | B1.0\|REF99_V4\|720 | 42 | 67 | 35 | 17 | | | | | | | | | | | | | | | | | | | | |
| 392 | 880 | B1.0\|REF99_V4\|472 | 1007 | B1.0\|REF99_V4\|9526 | 42 | 44 | 29 | 11 | | | | | | | | | | | | | | | | | | | | |
| 398 | 818 | B1.0\|REF99_V4\|531 | 837 | B1.0\|REF99_V4\|720 | 36 | 67 | 32 | 14 | | | | | | | | | | | | | | | | | | | | |
| 400 | 1012 | B1.0\|REF99_V4\|597 | 837 | B1.0\|REF99_V4\|720 | 39 | 67 | 39 | 16 | | | | | | | | | | | | | | | | | | | | |
| 401 | 1012 | B1.0\|REF99_V4\|597 | 713 | B1.0\|REF99_V4\|754 | 39 | 39 | 28 | 9 | | | | | | | | | | | | | | | | | | | | |
| 403 | 1012 | B1.0\|REF99_V4\|597 | 1007 | B1.0\|REF99_V4\|9526 | 39 | 44 | 35 | 10 | | | | | | | | | | | | | | | | | | | | |
| 407 | 837 | B1.0\|REF99_V4\|720 | 1007 | B1.0\|REF99_V4\|9526 | 67 | 44 | 41 | 18 | | | | | | | | | | | | | | | | | | | | |
| 409 | 713 | B1.0\|REF99_V4\|754 | 1007 | B1.0\|REF99_V4\|9526 | 39 | 44 | 27 | 10 | | | | | | | | | | | | | | | | | | | | |
| 421 | 1089 | B1.0\|REF97_V4\|127 | 1112 | B1.0\|REF99_V4\|14460 | | | | | | | | | | | | | | | | | | | | | | | | |
| 429 | 1098 | B1.0\|REF97_V4\|171 | 1104 | B1.0\|REF99_V4\|122519 | | | | | | | | | | | | | | | | | | | | | | | | |
| 431 | 1098 | B1.0\|REF97_V4\|171 | 1098 | B1.0\|REF99_V4\|171 | | | | | 17 | 31 | 17 | 13 | | | | | | | | | | | | | | | | |
| 529 | 260 | B1.0\|REF97_V4\|14662 | 260 | B1.0\|REF99_V4\|14662 | | | | | | | | | 53 | 81 | 48 | 34 | | | | | | | | | | | | |
| 539 | 974 | B1.0\|REF97_V4\|2831 | 1012 | B1.0\|REF99_V4\|597 | 42 | 24 | 24 | 6 | | | | | 26 | 30 | 20 | 6 | | | | | | | | | | | | |
| 542 | 974 | B1.0\|REF97_V4\|2831 | 54 | B1.0\|REF99_V4\|118524 | 42 | 24 | 24 | 6 | | | | | 17 | 23 | 16 | 3 | | | | | | | | | | | | |
| 548 | 974 | B1.0\|REF97_V4\|2831 | 684 | B1.0\|REF99_V4\|172 | 42 | 73 | 41 | 18 | | | | | | | | | | | | | | | | | | | | |
| 565 | 916 | B1.0\|REF97_V4\|3675 | 684 | B1.0\|REF99_V4\|172 | 37 | 73 | 36 | 16 | | | | | | | | | | | | | | | | | | | | |
| 572 | 1012 | B1.0\|REF97_V4\|597 | 959 | B1.0\|REF99_V4\|126 | 24 | 35 | 23 | 6 | | | | | | | | | | | | | | | | | | | | |
| 575 | 1012 | B1.0\|REF97_V4\|597 | 810 | B1.0\|REF99_V4\|1250 | 24 | 39 | 23 | 5 | | | | | | | | | | | | | | | | | | | | |
| 576 | 1012 | B1.0\|REF97_V4\|597 | 974 | B1.0\|REF99_V4\|2831 | 24 | 42 | 24 | 6 | | | | | | | | | | | | | | | | | | | | |
| 579 | 1012 | B1.0\|REF97_V4\|597 | 1012 | B1.0\|REF99_V4\|597 | 24 | 39 | 24 | 6 | | | | | | | | | | | | | | | | | | | | |
| 589 | 837 | B1.0\|REF97_V4\|720 | 684 | B1.0\|REF99_V4\|172 | 42 | 59 | 35 | 15 | | | | | | | | | | | | | | | | | | | | |
| 594 | 837 | B1.0\|REF97_V4\|720 | 121 | B1.0\|REF99_V4\|1211 | 42 | 73 | 41 | 18 | | | | | | | | | | | | | | | | | | | | |
| 603 | 837 | B1.0\|REF97_V4\|720 | 818 | B1.0\|REF99_V4\|531 | 42 | 36 | 28 | 9 | | | | | | | | | | | | | | | | | | | | |
| 607 | 510 | B1.0\|REF97_V4\|48981 | 1191 | B1.0\|REF99_V4\|150716 | | | | | | | | | | | | | | | | | | | | | | | | |
| 608 | 1007 | B1.0\|REF97_V4\|9526 | 892 | B1.0\|REF99_V4\|1177 | | | | | 22 | 15 | 13 | 8 | | | | | | | | | | | | | | | | |
| 622 | 137 | B1.0\|REF99_V4\|11 | 684 | B1.0\|REF99_V4\|172 | 65 | 73 | 47 | 28 | | | | | 26 | 30 | 19 | 6 | | | | | | | | | | | | |
| 633 | 850 | B1.0\|REF99_V4\|11157 | 719 | B1.0\|REF99_V4\|385 | | | | | 21 | 27 | 18 | 14 | | | | | | | | | | | | | | | | |

TABLE 15-continued

| PAIR | Endophyte 1 (SEQ ID NO:) | Endophyte 1 (OTU) | Endophyte 2 (SEQ ID NO:) | Endophyte 2 (OTU) | F Bacteria - monocots | | | | G Bacteria - monocots, roots | | | | H Bacteria - monocots, seeds | | | | I Fungi - monocots | | | | J Fungi - monocots, roots | | | | K Fungi - monocots, seeds | | | |
|---|---|---|---|---|---|---|---|---|---|---|---|---|---|---|---|---|---|---|---|---|---|---|---|---|---|---|---|---|
| A | B | C | D | E | N1 | N2 | OC | EC | N1 | N2 | OC | EC | N1 | N2 | OC | EC | N1 | N2 | OC | EC | N1 | N2 | OC | EC | N1 | N2 | OC | EC |
| 655 | 54 | B1.0|REF99_V4|118524 | 959 | B1.0|REF99_V4|126 | 24 | 39 | 24 | 6 | | | | | | | | | | | | | | | | | | | | |
| 659 | 54 | B1.0|REF99_V4|118524 | 974 | B1.0|REF99_V4|2831 | 24 | 42 | 24 | 6 | | | | | | | | | | | | | | | | | | | | |
| 660 | 54 | B1.0|REF99_V4|118524 | 916 | B1.0|REF99_V4|3675 | 24 | 40 | 23 | 6 | | | | | | | | | | | | | | | | | | | | |
| 671 | 121 | B1.0|REF99_V4|1211 | 1184 | B1.0|REF99_V4|20510 | | | | | 32 | 21 | 21 | 16 | | | | | | | | | | | | | | | | |
| 674 | 121 | B1.0|REF99_V4|1211 | 837 | B1.0|REF99_V4|1720 | 59 | 67 | 43 | 24 | | | | | | | | | | | | | | | | | | | | |
| 675 | 1104 | B1.0|REF99_V4|122519 | 1091 | B1.0|REF99_V4|15 | | | | | | | | | 30 | 45 | 24 | 11 | | | | | | | | | | | | |
| 683 | 959 | B1.0|REF99_V4|126 | 684 | B1.0|REF99_V4|172 | 39 | 73 | 38 | 17 | | | | | | | | | | | | | | | | | | | | |
| 709 | 939 | B1.0|REF99_V4|1317 | 683 | B1.0|REF99_V4|2385 | | | | | 18 | 22 | 14 | 9 | | | | | | | | | | | | | | | | |
| 719 | 71 | B1.0|REF99_V4|1351 | 684 | B1.0|REF99_V4|172 | 36 | 73 | 34 | 16 | | | | | | | | | | | | | | | | | | | | |
| 738 | 1112 | B1.0|REF99_V4|14460 | 1086 | B1.0|REF99_V4|25794 | 81 | 52 | 42 | 25 | | | | | | | | | | | | | | | | | | | | |
| 740 | 116 | B1.0|REF99_V4|1567 | 1171 | B1.0|REF99_V4|1639 | 39 | 27 | 25 | 6 | | | | | | | | | | | | | | | | | | | | |
| 746 | 1171 | B1.0|REF99_V4|1639 | 789 | B1.0|REF99_V4|2172 | 27 | 52 | 27 | 8 | | | | | | | | | | | | | | | | | | | | |
| 747 | 1171 | B1.0|REF99_V4|1639 | 810 | B1.0|REF99_V4|1250 | 27 | 35 | 24 | 6 | | | | | | | | | | | | | | | | | | | | |
| 748 | 1171 | B1.0|REF99_V4|1639 | 1012 | B1.0|REF99_V4|597 | 27 | 39 | 25 | 6 | | | | | | | | | | | | | | | | | | | | |
| 764 | 684 | B1.0|REF99_V4|172 | 789 | B1.0|REF99_V4|2172 | 73 | 52 | 40 | 23 | | | | | | | | | | | | | | | | | | | | |
| 766 | 684 | B1.0|REF99_V4|172 | 810 | B1.0|REF99_V4|1250 | 73 | 35 | 35 | 15 | | | | | | | | | | | | | | | | | | | | |
| 767 | 684 | B1.0|REF99_V4|172 | 974 | B1.0|REF99_V4|2831 | 73 | 42 | 41 | 18 | | | | | | | | | | | | | | | | | | | | |
| 768 | 684 | B1.0|REF99_V4|172 | 789 | B1.0|REF99_V4|2172 | 73 | 32 | 31 | 14 | | | | | | | | | | | | | | | | | | | | |
| 769 | 684 | B1.0|REF99_V4|172 | 615 | B1.0|REF99_V4|13374 | 73 | 40 | 39 | 17 | | | | | | | | | | | | | | | | | | | | |
| 770 | 684 | B1.0|REF99_V4|172 | 916 | B1.0|REF99_V4|3675 | 73 | 42 | 35 | 18 | | | | | | | | | | | | | | | | | | | | |
| 771 | 684 | B1.0|REF99_V4|172 | 880 | B1.0|REF99_V4|1472 | 73 | 39 | 38 | 17 | | | | | | | | | | | | | | | | | | | | |
| 772 | 684 | B1.0|REF99_V4|172 | 1012 | B1.0|REF99_V4|597 | 73 | 67 | 49 | 29 | | | | | | | | | | | | | | | | | | | | |
| 773 | 684 | B1.0|REF99_V4|172 | 837 | B1.0|REF99_V4|1720 | 73 | 44 | 39 | 19 | | | | | | | | | | | | | | | | | | | | |
| 778 | 889 | B1.0|REF99_V4|185 | 1007 | B1.0|REF99_V4|9526 | 35 | 30 | 23 | 6 | | | | | | | | | | | | | | | | | | | | |
| 782 | 889 | B1.0|REF99_V4|185 | 1011 | B1.0|REF99_V4|2104 | 35 | 44 | 26 | 9 | | | | | | | | | | | | | | | | | | | | |
| 830 | 131 | B1.0|REF99_V4|251 | 880 | B1.0|REF99_V4|1472 | 33 | 42 | 25 | 8 | | | | | | | | | | | | | | | | | | | | |
| 858 | 719 | B1.0|REF99_V4|385 | 837 | B1.0|REF99_V4|1720 | 55 | 67 | 39 | 22 | | | | | | | | | | | | | | | | | | | | |
| 881 | 1171 | B1.0|REF97_V4|1639 | 892 | B1.0|REF99_V4|1177 | | | | | 15 | 15 | 10 | 5 | | | | | | | | | | | | | | | | |
| 882 | 1171 | B1.0|REF97_V4|1639 | 1171 | B1.0|REF99_V4|1639 | | | | | 15 | 27 | 15 | 10 | | | | | | | | | | | | | | | | |
| 885 | 430 | B1.0|REF97_V4|4659 | 839 | B1.0|REF99_V4|11186 | | | | | 8 | 19 | 8 | 4 | | | | | | | | | | | | | | | | |
| 886 | 430 | B1.0|REF97_V4|4659 | 430 | B1.0|REF99_V4|4659 | | | | | 8 | 20 | 8 | 4 | | | | | | | | | | | | | | | | |
| 888 | 1007 | B1.0|REF97_V4|9526 | 890 | B1.0|REF99_V4|1811 | | | | | 22 | 13 | 12 | 7 | | | | | | | | | | | | | | | | |
| 914 | 1184 | B1.0|REF99_V4|20510 | 845 | B1.0|REF99_V4|2959 | | | | | 21 | 19 | 16 | 10 | | | | | | | | | | | | | | | | |
| 915 | 1184 | B1.0|REF99_V4|20510 | 957 | B1.0|REF99_V4|4921 | | | | | 21 | 12 | 11 | 6 | | | | | | | | | | | | | | | | |
| 917 | 693 | B1.0|REF99_V4|22483 | 689 | B1.0|REF99_V4|2546 | | | | | 7 | 11 | 6 | 2 | | | | | | | | | | | | | | | | |
| 924 | 845 | B1.0|REF99_V4|2959 | 957 | B1.0|REF99_V4|4921 | | | | | 19 | 12 | 11 | 5 | | | | | | | | | | | | | | | | |
| 933 | 1108 | B1.0|REF99_V4|1 | 1086 | B1.0|REF99_V4|25794 | 43 | 52 | 31 | 13 | | | | | 18 | 13 | 10 | 6 | | | | | | | | | | | | |
| 934 | 1089 | B1.0|REF97_V4|127 | 1088 | B1.0|REF99_V4|1703 | | | | | | | | | 53 | 62 | 44 | 26 | | | | | | | | | | | | |
| 963 | 1191 | B1.0|REF99_V4|150716 | 510 | B1.0|REF99_V4|18981 | | | | | | | | | 30 | 27 | 19 | 6 | | | | | | | | | | | | |
| 1036 | 1108 | B1.0|REF97_V4|1 | 1097 | B1.0|REF99_V4|159716 | 43 | 30 | 27 | 8 | | | | | 30 | 39 | 27 | 9 | | | | | | | | | | | | |
| 1070 | 1097 | B1.0|REF97_V4|159716 | 1093 | B1.0|REF99_V4|29 | 30 | 43 | 27 | 8 | | | | | 52 | 28 | 25 | 12 | | | | | | | | | | | | |
| 1084 | 1086 | B1.0|REF99_V4|25794 | 1083 | B1.0|REF99_V4|26074 | | | | | 18 | 13 | 10 | 6 | | | | | | | | | | | | | | | | |
| 1382 | 939 | B1.0|REF99_V4|1317 | 1221 | B1.0|REF99_V4|2512 | | | | | | | | | 72 | 51 | 44 | 29 | | | | | | | | | | | | |
| 1938 | 982 | B1.0|REF99_V4|118 | 1195 | B1.0|REF99_V4|1916 | 79 | 51 | 44 | 24 | | | | | 72 | 73 | 55 | 42 | | | | | | | | | | | | |
| 1943 | 982 | B1.0|REF99_V4|118 | 881 | B1.0|REF99_V4|1434 | 79 | 74 | 55 | 35 | | | | | | | | | | | | | | | | | | | | |
| 2061 | 313 | B1.0|REF99_V4|18024 | 845 | B1.0|REF99_V4|2959 | | | | | 15 | 19 | 11 | 7 | | | | | | | | | | | | | | | | |
| 2290 | 137 | B1.0|REF99_V4|11 | 889 | B1.0|REF99_V4|185 | 65 | 35 | 31 | 14 | | | | | | | | | | | | | | | | | | | | |

TABLE 15-continued

| A PAIR | B Endophyte 1 (SEQ ID NO:)(OTU) | C Endophyte 1 | D Endophyte 2 (SEQ ID NO:)(OTU) | E Endophyte 2 | F Bacteria - monocots | | | | G Bacteria - monocots, roots | | | | H Bacteria - monocots, seeds | | | | I Fungi - monocots | | | | J Fungi - monocots, roots | | | | K Fungi - monocots, seeds | | | |
|---|---|---|---|---|---|---|---|---|---|---|---|---|---|---|---|---|---|---|---|---|---|---|---|---|---|---|---|---|
| | | | | | N1 | N2 | OC | EC | N1 | N2 | OC | EC | N1 | N2 | OC | EC | N1 | N2 | OC | EC | N1 | N2 | OC | EC | N1 | N2 | OC | EC |
| 2341 | 959 | B1.0\|REF97_V4\|126 | 889 | B1.0\|REF99_V4\|185 | 39 | 35 | 25 | 8 | | | | | | | | | | | | | | | | | | | | |
| 2402 | 889 | B1.0\|REF97_V4\|185 | 943 | B1.0\|REF99_V4\|26030 | 35 | 33 | 24 | 7 | | | | | | | | | | | | | | | | | | | | |
| 3080 | 1108 | B1.0\|REF97_V4\|1 | 870 | B1.0\|REF99_V4\|5106 | | | | | 12 | 16 | 9 | 5 | | | | | | | | | | | | | | | | |
| 3081 | 959 | B1.0\|REF97_V4\|126 | 850 | B1.0\|REF99_V4\|11157 | | | | | 21 | 21 | 17 | 11 | | | | | | | | | | | | | | | | |
| 3082 | 959 | B1.0\|REF97_V4\|126 | 845 | B1.0\|REF99_V4\|2959 | | | | | 21 | 19 | 15 | 10 | | | | | | | | | | | | | | | | |
| 3083 | 1171 | B1.0\|REF97_V4\|1639 | 1007 | B1.0\|REF99_V4\|9526 | | | | | 15 | 22 | 14 | 8 | | | | | | | | | | | | | | | | |
| 3084 | 1171 | B1.0\|REF97_V4\|1639 | 879 | B1.0\|REF99_V4\|1349 | | | | | 15 | 9 | 8 | 3 | | | | | | | | | | | | | | | | |
| 3085 | 1171 | B1.0\|REF97_V4\|1639 | 890 | B1.0\|REF99_V4\|1811 | | | | | 15 | 13 | 10 | 5 | | | | | | | | | | | | | | | | |
| 3086 | 1098 | B1.0\|REF97_V4\|1639 | 696 | B1.0\|REF99_V4\|14891 | | | | | 17 | 10 | 9 | 4 | | | | | | | | | | | | | | | | |
| 3087 | 889 | B1.0\|REF97_V4\|185 | 883 | B1.0\|REF99_V4\|287 | | | | | 9 | 9 | 7 | 2 | | | | | | | | | | | | | | | | |
| 3088 | 880 | B1.0\|REF97_V4\|472 | 870 | B1.0\|REF99_V4\|5106 | | | | | 7 | 16 | 7 | 3 | | | | | | | | | | | | | | | | |
| 3089 | 1012 | B1.0\|REF97_V4\|597 | 977 | B1.0\|REF99_V4\|11337 | | | | | 24 | 14 | 13 | 8 | | | | | | | | | | | | | | | | |
| 3090 | 1106 | B1.0\|REF97_V4\|466 | 1090 | B1.0\|REF99_V4\|79117 | | | | | 29 | 17 | 17 | 12 | | | | | | | | | | | | | | | | |
| 3091 | 1007 | B1.0\|REF97_V4\|9526 | 405 | B1.0\|REF99_V4\|13726 | | | | | 22 | 13 | 11 | 7 | | | | | | | | | | | | | | | | |
| 3092 | 850 | B1.0\|REF99_V4\|11157 | 1184 | B1.0\|REF99_V4\|20510 | | | | | 21 | 21 | 15 | 11 | | | | | | | | | | | | | | | | |
| 3093 | 850 | B1.0\|REF99_V4\|11157 | 845 | B1.0\|REF99_V4\|2959 | | | | | 21 | 19 | 17 | 10 | | | | | | | | | | | | | | | | |
| 3094 | 850 | B1.0\|REF99_V4\|11157 | 957 | B1.0\|REF99_V4\|4921 | | | | | 21 | 12 | 11 | 6 | | | | | | | | | | | | | | | | |
| 3095 | 892 | B1.0\|REF99_V4\|1177 | 890 | B1.0\|REF99_V4\|1811 | | | | | 15 | 13 | 10 | 5 | | | | | | | | | | | | | | | | |
| 3096 | 839 | B1.0\|REF99_V4\|1186 | 845 | B1.0\|REF99_V4\|2959 | | | | | 19 | 19 | 14 | 9 | | | | | | | | | | | | | | | | |
| 3097 | 886 | B1.0\|REF99_V4\|1287 | 430 | B1.0\|REF99_V4\|659 | | | | | 22 | 20 | 15 | 11 | | | | | | | | | | | | | | | | |
| 3098 | 939 | B1.0\|REF99_V4\|1317 | 1220 | B1.0\|REF99_V4\|20595 | | | | | 18 | 13 | 10 | 5 | | | | | | | | | | | | | | | | |
| 3099 | 939 | B1.0\|REF99_V4\|1317 | 689 | B1.0\|REF99_V4\|2546 | | | | | 18 | 11 | 9 | 5 | | | | | | | | | | | | | | | | |
| 3100 | 939 | B1.0\|REF99_V4\|1317 | 430 | B1.0\|REF99_V4\|659 | | | | | 18 | 20 | 13 | 9 | | | | | | | | | | | | | | | | |
| 3101 | 405 | B1.0\|REF99_V4\|13726 | 945 | B1.0\|REF99_V4\|442 | | | | | 13 | 20 | 11 | 6 | | | | | | | | | | | | | | | | |
| 3102 | 696 | B1.0\|REF99_V4\|14891 | 945 | B1.0\|REF99_V4\|442 | | | | | 10 | 20 | 9 | 5 | | | | | | | | | | | | | | | | |
| 3103 | 889 | B1.0\|REF99_V4\|185 | 870 | B1.0\|REF99_V4\|5106 | | | | | 28 | 16 | 15 | 11 | | | | | | | | | | | | | | | | |
| 3104 | 1184 | B1.0\|REF99_V4\|20510 | 1221 | B1.0\|REF99_V4\|2512 | | | | | 21 | 13 | 11 | 7 | | | | | | | | | | | | | | | | |
| 3105 | 1221 | B1.0\|REF99_V4\|2512 | 845 | B1.0\|REF99_V4\|2959 | | | | | 13 | 19 | 11 | 6 | | | | | | | | | | | | | | | | |
| 3106 | 1221 | B1.0\|REF99_V4\|2512 | 957 | B1.0\|REF99_V4\|4921 | | | | | 13 | 12 | 9 | 4 | | | | | | | | | | | | | | | | |
| 3107 | 845 | B1.0\|REF99_V4\|2959 | 719 | B1.0\|REF99_V4\|385 | | | | | 19 | 27 | 17 | 12 | | | | | | | | | | | | | | | | |
| 3108 | 1003 | B1.0\|REF99_V4\|4502 | 388 | B1.0\|REF99_V4\|5893 | | | | | 11 | 7 | 6 | 2 | | | | | | | | | | | | | | | | |
| 3109 | 1070 | B1.0\|REF97_V4\|112446 | 1070 | B1.0\|REF99_V4\|112446 | | | | | | | | | 21 | 26 | 18 | 4 | | | | | | | | | | | | |
| 3110 | 1089 | B1.0\|REF97_V4\|127 | 1089 | B1.0\|REF99_V4\|127 | | | | | | | | | 53 | 95 | 53 | 40 | | | | | | | | | | | | |
| 3111 | 1089 | B1.0\|REF97_V4\|127 | 1109 | B1.0\|REF99_V4\|127 | | | | | | | | | 53 | 72 | 45 | 30 | | | | | | | | | | | | |
| 3112 | 1089 | B1.0\|REF97_V4\|127 | 510 | B1.0\|REF99_V4\|18981 | | | | | | | | | 53 | 27 | 24 | 11 | | | | | | | | | | | | |
| 3113 | 176 | B1.0\|REF97_V4\|5206 | 176 | B1.0\|REF99_V4\|5206 | | | | | | | | | 20 | 33 | 18 | 5 | | | | | | | | | | | | |
| 3114 | 1106 | B1.0\|REF97_V4\|466 | 1112 | B1.0\|REF99_V4\|114460 | | | | | | | | | 57 | 81 | 52 | 37 | | | | | | | | | | | | |
| 3115 | 1106 | B1.0\|REF97_V4\|466 | 1109 | B1.0\|REF99_V4\|25629 | | | | | | | | | 57 | 72 | 47 | 33 | | | | | | | | | | | | |
| 3116 | 1110 | B1.0\|REF97_V4\|108549 | 1091 | B1.0\|REF99_V4\|415 | | | | | | | | | 32 | 45 | 26 | 11 | | | | | | | | | | | | |
| 3117 | 1110 | B1.0\|REF97_V4\|108549 | 1083 | B1.0\|REF99_V4\|126074 | | | | | | | | | 32 | 28 | 22 | 7 | | | | | | | | | | | | |
| 3118 | 1099 | B1.0\|REF97_V4\|111708 | 1091 | B1.0\|REF99_V4\|415 | | | | | | | | | 27 | 45 | 23 | 10 | | | | | | | | | | | | |
| 3119 | 1104 | B1.0\|REF97_V4\|122519 | 1080 | B1.0\|REF99_V4\|415 | | | | | | | | | 30 | 39 | 22 | 9 | | | | | | | | | | | | |
| 3120 | 1089 | B1.0\|REF99_V4\|127 | 1088 | B1.0\|REF99_V4\|1703 | | | | | | | | | 95 | 62 | 61 | 47 | | | | | | | | | | | | |
| 3121 | 1091 | B1.0\|REF99_V4\|415 | 1081 | B1.0\|REF99_V4\|156009 | | | | | | | | | 45 | 48 | 33 | 17 | | | | | | | | | | | | |
| 3122 | 1091 | B1.0\|REF99_V4\|415 | 1097 | B1.0\|REF99_V4\|159716 | | | | | | | | | 45 | 30 | 24 | 11 | | | | | | | | | | | | |
| 3123 | 1091 | B1.0\|REF99_V4\|415 | 1088 | B1.0\|REF99_V4\|1703 | | | | | | | | | 45 | 62 | 37 | 22 | | | | | | | | | | | | |
| 3124 | 1081 | B1.0\|REF99_V4\|156009 | 1097 | B1.0\|REF99_V4\|159716 | | | | | | | | | 48 | 30 | 28 | 11 | | | | | | | | | | | | |

TABLE 15-continued

| PAIR | Endophyte 1 (SEQ ID NO:) | Endophyte 1 (OTU) | Endophyte 2 (SEQ ID NO:) | Endophyte 2 (OTU) | F Bacteria - monocots | | | | G Bacteria - monocots, roots | | | | H Bacteria - monocots, seeds | | | | I Fungi - monocots | | | | J Fungi - monocots, roots | | | | K Fungi - monocots, seeds | | | |
|---|---|---|---|---|---|---|---|---|---|---|---|---|---|---|---|---|---|---|---|---|---|---|---|---|---|---|---|---|
| A | B | C | D | E | N1 | N2 | OC | EC | N1 | N2 | OC | EC | N1 | N2 | OC | EC | N1 | N2 | OC | EC | N1 | N2 | OC | EC | N1 | N2 | OC | EC |
| 3125 | 1081 | B1.0\|REF99_V4\|56009 | 1080 | B1.0\|REF99_V4\|56009 | 48 | 42 | 32 | 12 | | | | | 48 | 39 | 32 | 15 | | | | | | | | | | | | |
| 3126 | 1081 | B1.0\|REF99_V4\|56009 | 1083 | B1.0\|REF99_V4\|26074 | 48 | 28 | 25 | 8 | | | | | 48 | 28 | 25 | 11 | | | | | | | | | | | | |
| 3127 | 1097 | B1.0\|REF99_V4\|59716 | 1080 | B1.0\|REF99_V4\|19 | 30 | 42 | 28 | 8 | | | | | 30 | 39 | 28 | 9 | | | | | | | | | | | | |
| 3128 | 1097 | B1.0\|REF99_V4\|59716 | 1083 | B1.0\|REF99_V4\|26074 | 30 | 28 | 23 | 5 | | | | | 30 | 28 | 23 | 7 | | | | | | | | | | | | |
| 3129 | 1080 | B1.0\|REF99_V4\|19 | 1083 | B1.0\|REF99_V4\|26074 | 42 | 28 | 24 | 7 | | | | | 39 | 28 | 24 | 9 | | | | | | | | | | | | |
| 3130 | 1083 | B1.0\|REF99_V4\|26074 | 1093 | B1.0\|REF99_V4\|29 | | | | | | | | | 28 | 39 | 22 | 9 | | | | | | | | | | | | |
| 3131 | 1108 | B1.0\|REF97_V4\|1 | 1081 | B1.0\|REF99_V4\|56009 | 43 | 48 | 30 | 12 | | | | | | | | | | | | | | | | | | | | |
| 3132 | 137 | B1.0\|REF97_V4\|11 | 116 | B1.0\|REF99_V4\|1567 | 36 | 39 | 27 | 8 | | | | | | | | | | | | | | | | | | | | |
| 3133 | 974 | B1.0\|REF97_V4\|2831 | 121 | B1.0\|REF99_V4\|1211 | 42 | 59 | 32 | 15 | | | | | | | | | | | | | | | | | | | | |
| 3134 | 837 | B1.0\|REF97_V4\|4720 | 1171 | B1.0\|REF99_V4\|1639 | 42 | 27 | 25 | 7 | | | | | | | | | | | | | | | | | | | | |
| 3135 | 372 | B1.0\|REF99_V4\|10206 | 1229 | B1.0\|REF99_V4\|1866 | 83 | 61 | 47 | 30 | | | | | | | | | | | | | | | | | | | | |
| 3136 | 850 | B1.0\|REF99_V4\|11157 | 684 | B1.0\|REF99_V4\|172 | 38 | 73 | 35 | 17 | | | | | | | | | | | | | | | | | | | | |
| 3137 | 121 | B1.0\|REF99_V4\|1211 | 684 | B1.0\|REF99_V4\|172 | 59 | 73 | 46 | 26 | | | | | | | | | | | | | | | | | | | | |
| 3138 | 121 | B1.0\|REF99_V4\|1211 | 974 | B1.0\|REF99_V4\|2831 | 59 | 42 | 32 | 15 | | | | | | | | | | | | | | | | | | | | |
| 3139 | 121 | B1.0\|REF99_V4\|1211 | 1012 | B1.0\|REF99_V4\|597 | 59 | 39 | 32 | 6 | | | | | | | | | | | | | | | | | | | | |
| 3140 | 959 | B1.0\|REF99_V4\|126 | 1171 | B1.0\|REF99_V4\|1639 | 39 | 27 | 25 | 17 | | | | | | | | | | | | | | | | | | | | |
| 3141 | 116 | B1.0\|REF99_V4\|1567 | 684 | B1.0\|REF99_V4\|172 | 39 | 73 | 34 | 17 | | | | | | | | | | | | | | | | | | | | |
| 3142 | 1171 | B1.0\|REF99_V4\|1639 | 1007 | B1.0\|REF99_V4\|9526 | 27 | 44 | 25 | 7 | | | | | | | | | | | | | | | | | | | | |
| 3143 | 684 | B1.0\|REF99_V4\|172 | 943 | B1.0\|REF99_V4\|26030 | 73 | 33 | 32 | 14 | | | | | | | | | | | | | | | | | | | | |
| 3678 | 1515 | F1.0\|SYM97_ITS1F\|31 | 1683 | F1.0\|SYM97_ITS1F\|51 | | | | | | | | | | | | | 36 | 20 | 19 | 7 | | | | | | | | |
| 3681 | 1515 | F1.0\|SYM97_ITS1F\|31 | 1574 | F1.0\|U97_ITS1F\|479 | | | | | | | | | | | | | 36 | 25 | 22 | 8 | | | | | | | | |
| 3682 | 1515 | F1.0\|SYM97_ITS1F\|31 | 1575 | F1.0\|UDYN_ITS1F\|137 | | | | | | | | | | | | | 36 | 31 | 26 | 10 | | | | | | | | |
| 3683 | 1515 | F1.0\|SYM97_ITS1F\|31 | 1573 | F1.0\|UDYN_ITS1F\|60 | | | | | | | | | | | | | 36 | 20 | 19 | 7 | | | | | | | | |
| 3684 | 1515 | F1.0\|SYM97_ITS1F\|31 | 1557 | F1.0\|UDYN_ITS1F\|621 | | | | | | | | | | | | | 36 | 37 | 30 | 12 | | | | | | | | |
| 3690 | 1682 | F1.0\|SYM97_ITS1F\|74 | 1581 | F1.0\|UDYN_ITS1F\|84 | | | | | | | | | | | | | 19 | 37 | 18 | 7 | | | | | | | | |
| 3691 | 1574 | F1.0\|U97_ITS1F\|479 | 1592 | F1.0\|UDYN_ITS1F\|627 | | | | | | | | | | | | | 25 | 31 | 22 | 7 | | | | | | | | |
| 3693 | 1574 | F1.0\|U97_ITS1F\|479 | 1581 | F1.0\|UDYN_ITS1F\|84 | | | | | | | | | | | | | 25 | 37 | 23 | 9 | 25 | 29 | 22 | 17 | | | | |
| 3694 | 1655 | F1.0\|U97_ITS1F\|628 | 1533 | F1.0\|UDYN_ITS1F\|458 | | | | | | | | | | | | | | | | | 29 | 20 | 20 | 14 | | | | |
| 3695 | 1575 | F1.0\|U97_ITS1F\|137 | 1573 | F1.0\|UDYN_ITS1F\|60 | | | | | | | | | | | | | 31 | 20 | 20 | 6 | | | | | | | | |
| 3696 | 1575 | F1.0\|U97_ITS1F\|137 | 1557 | F1.0\|UDYN_ITS1F\|621 | | | | | | | | | | | | | 31 | 37 | 25 | 11 | | | | | | | | |
| 3697 | 1672 | F1.0\|UDYN_ITS1F\|451 | 1655 | F1.0\|UDYN_ITS1F\|628 | | | | | | | | | | | | | 68 | 62 | 56 | 39 | 16 | 13 | 12 | 5 | | | | |
| 3698 | 1523 | F1.0\|UDYN_ITS1F\|486 | 1481 | F1.0\|UDYN_ITS1F\|548 | | | | | | | | | | | | | 49 | 55 | 39 | 25 | | | | | | | | |
| 3699 | 1523 | F1.0\|UDYN_ITS1F\|486 | 1581 | F1.0\|UDYN_ITS1F\|84 | | | | | | | | | | | | | 49 | 57 | 43 | 26 | | | | | | | | |
| 3700 | 1596 | F1.0\|UDYN_ITS1F\|508 | 1592 | F1.0\|UDYN_ITS1F\|627 | | | | | | | | | | | | | 38 | 27 | 27 | 10 | 37 | 27 | 27 | 15 | | | | |
| 3701 | 1596 | F1.0\|UDYN_ITS1F\|508 | 1581 | F1.0\|UDYN_ITS1F\|84 | | | | | | | | | | | | | 38 | 57 | 33 | 20 | | | | | | | | |
| 3702 | 1573 | F1.0\|UDYN_ITS1F\|60 | 1557 | F1.0\|UDYN_ITS1F\|621 | | | | | | | | | | | | | 20 | 37 | 18 | 7 | | | | | | | | |
| 3726 | 1673 | F1.0\|UDYN_ITS1F\|122 | 1576 | F1.0\|UDYN_ITS1F\|1112 | | | | | | | | | | | | | 19 | 37 | 18 | 7 | 15 | 20 | 12 | 7 | | | | |
| 3739 | 1557 | F1.0\|UDYN_ITS1F\|621 | 1557 | F1.0\|UDYN_ITS1F\|621 | | | | | | | | | | | | | 37 | 21 | 18 | 7 | 14 | 18 | 11 | 6 | | | | |
| 3753 | 1690 | F1.0\|UDYN_ITS1F\|463 | 1521 | F1.0\|UDYN_ITS1F\|73 | | | | | | | | | | | | | | | | | 11 | 16 | 10 | 4 | | | | |
| 3757 | 1557 | F1.0\|UDYN_ITS1F\|621 | 1493 | F1.0\|U97_ITS1F\|378 | | | | | | | | | | | | | 16 | 23 | 15 | 3 | 9 | 14 | 8 | 3 | | | | |
| 3761 | 1514 | F1.0\|UDYN_ITS1F\|369 | 1529 | F1.0\|U97_ITS1F\|80 | | | | | | | | | | | | | 22 | 25 | 16 | 5 | | | | | | | | |
| 3764 | 1529 | F1.0\|U97_ITS1F\|80 | 1589 | F1.0\|U97_ITS1F\|83 | | | | | | | | | | | | | | | | | 11 | 17 | 10 | 5 | | | | |
| 3769 | 1586 | F1.0\|U97_ITS1F\|110 | 1629 | F1.0\|U97_ITS1F\|603 | | | | | | | | | | | | | | | | | 11 | 9 | 7 | 2 | | | | |
| 3822 | 1629 | F1.0\|U97_ITS1F\|603 | 1647 | F1.0\|U97_ITS1F\|142 | | | | | | | | | | | | | | | | | 12 | 16 | 9 | 5 | 17 | 18 | 13 | 5 |
| 3890 | 1692 | F1.0\|SYM97_ITS1F\|2 | 1510 | F1.0\|SYM97_ITS1F\|6 | | | | | | | | | | | | | | | | | | | | | 37 | 27 | 27 | 15 |
| 3891 | 1514 | F1.0\|SYM97_ITS1F\|369 | 1493 | F1.0\|SYM97_ITS1F\|378 | | | | | | | | | | | | | | | | | | | | | 22 | 25 | 16 | 8 |
| 3892 | 1684 | F1.0\|SYM97_ITS1F\|462 | 1493 | F1.0\|U97_ITS1F\|378 | | | | | | | | | | | | | | | | | | | | | | | | |

TABLE 15-continued

| A PAIR | B Endophyte 1 (SEQ ID NO:) | C Endophyte 1 (OTU) | D Endophyte 2 (SEQ ID NO:) | E Endophyte 2 (OTU) | F Bacteria - monocots | | | | G Bacteria - monocots, roots | | | | H Bacteria - monocots, seeds | | | | I Fungi - monocots | | | | J Fungi - monocots, roots | | | | K Fungi - monocots, seeds | | | |
|---|---|---|---|---|---|---|---|---|---|---|---|---|---|---|---|---|---|---|---|---|---|---|---|---|---|---|---|---|
| | | | | | N1 | N2 | OC | EC | N1 | N2 | OC | EC | N1 | N2 | OC | EC | N1 | N2 | OC | EC | N1 | N2 | OC | EC | N1 | N2 | OC | EC |
| 3893 | 1510 | F1.0\|SYM97_ITS1Fj6 | 1493 | F1.0\|U97_ITS1Fj378 | | | | | | | | | | | | | | | | | | | | | | | | |
| 3894 | 1629 | F1.0\|UDYN_ITS1Fj603 | 1655 | F1.0\|UDYN_ITS1Fj628 | | | | | | | | | | | | | 22 | 38 | 19 | 8 | 7 | 16 | 7 | 3 | 22 | 37 | 19 | 12 |
| 3895 | 1586 | F1.0\|UDYN_ITS1Fj110 | 1596 | F1.0\|UDYN_ITS1Fj508 | | | | | | | | | | | | | 29 | 38 | 23 | 10 | 17 | 13 | 10 | 5 | 22 | 37 | 22 | 12 |
| 3896 | 1593 | F1.0\|UDYN_ITS1Fj16 | 1605 | F1.0\|UDYN_ITS1Fj6 | | | | | | | | | | | | | 29 | 45 | 27 | 12 | | | | | 22 | 24 | 20 | 8 |
| 3897 | 1593 | F1.0\|UDYN_ITS1Fj16 | 1592 | F1.0\|UDYN_ITS1Fj627 | | | | | | | | | | | | | 29 | 27 | 22 | 7 | | | | | 22 | 27 | 22 | 9 |
| 3898 | 1596 | F1.0\|UDYN_ITS1Fj16 | 1605 | F1.0\|UDYN_ITS1Fj6 | | | | | | | | | | | | | | | | | | | | | 37 | 24 | 21 | 14 |
| 3899 | 1605 | F1.0\|UDYN_ITS1Fj508 | 1592 | F1.0\|UDYN_ITS1Fj627 | | | | | | | | | | | | | | | | | | | | | 24 | 27 | 21 | 10 |
| 3900 | 1576 | F1.0\|UDYN_ITS1Fj6 | 1557 | F1.0\|UDYN_ITS1Fj621 | | | | | | | | | | | | | | | | | | | | | | | | |
| 3901 | 1576 | F1.0\|UDYN_ITS1Fj112 | 1557 | F1.0\|UDYN_ITS1Fj621 | | | | | | | | | | | | | 18 | 37 | 17 | 6 | | | | | | | | |
| 3902 | 1523 | F1.0\|UDYN_ITS1Fj486 | 1596 | F1.0\|UDYN_ITS1Fj508 | | | | | | | | | | | | | 49 | 38 | 30 | 17 | | | | | | | | |
| 3903 | 1481 | F1.0\|UDYN_ITS1Fj548 | 1581 | F1.0\|UDYN_ITS1Fj84 | | | | | | | | | | | | | 55 | 57 | 40 | 29 | | | | | | | | |
| 3904 | 1592 | F1.0\|UDYN_ITS1Fj627 | 1581 | F1.0\|UDYN_ITS1Fj84 | | | | | | | | | | | | | 27 | 57 | 25 | 14 | | | | | | | | |

Table 16: Pairs of Endophytes Useful for the Present Invention, as Identified by Co-Occurrence Analysis of Various Plant Samples.

Column A shows the pair number. Columns B and C show the SEQ ID NO: and OTU designation for endophyte 1 of a pair. Columns D and E show the SEQ ID NO: and OTU designation for endophyte 2 of a pair. Columns F, G, H, and I show the number of times microbes belonging to OTU1 occur in a sample (N1), the number of times microbes belonging to OTU2 occur in a sample (N2), the number of times the microbes co-occur in all the plant samples of the collection or a subgroup of those plant samples (OC), and the number of times microbes of those OTUs would be expected to co-occur (EC). In this table, "Bacteria—Brassicaceae" represents a co-occurrence analysis using all Brassicaceae plant samples of the collection, to identify bacteria that co-occur in these samples. "Fungi—Brassicaceae" represents a co-occurrence analysis using all Brassicaceae plant samples of the collection, to identify fungi that co-occur in these samples. "Bacteria—Poaceae" represents a co-occurrence analysis using all Poaceae samples from plant samples of the collection, to identify bacteria that co-occur in these samples. "Fungi—Poaceae" represents a co-occurrence analysis using all Poaceae plant samples of the collection, to identify fungi that co-occur in these samples.

TABLE 16

| A PAIR | B Endophyte 1 (SEQ ID NO:) | C Endophyte 1 (OTU) | D Endophyte 2 (SEQ ID NO:) | E Endophyte 2 (OTU) | F Bacteria - Brassicaceae | | | |
|---|---|---|---|---|---|---|---|---|
| | | | | | N1 | N2 | OC | EC |
| 1 | 1108 | B1.0|REF97__V4|1 | 1110 | B1.0|REF99__V4|108549 | 7 | 8 | 7 | 2 |
| 2 | 1108 | B1.0|REF97__V4|1 | 1080 | B1.0|REF99__V4|19 | | | | |
| 3 | 1108 | B1.0|REF97__V4|1 | 1093 | B1.0|REF99__V4|29 | | | | |
| 4 | 137 | B1.0|REF97__V4|11 | 974 | B1.0|REF97__V4|2831 | | | | |
| 5 | 137 | B1.0|REF97__V4|11 | 916 | B1.0|REF97__V4|3675 | | | | |
| 6 | 137 | B1.0|REF97__V4|11 | 137 | B1.0|REF99__V4|11 | | | | |
| 8 | 137 | B1.0|REF97__V4|11 | 789 | B1.0|REF99__V4|2172 | | | | |
| 9 | 137 | B1.0|REF97__V4|11 | 974 | B1.0|REF99__V4|2831 | | | | |
| 10 | 137 | B1.0|REF97__V4|11 | 916 | B1.0|REF99__V4|3675 | | | | |
| 11 | 137 | B1.0|REF97__V4|11 | 1012 | B1.0|REF99__V4|597 | | | | |
| 12 | 137 | B1.0|REF97__V4|11 | 1007 | B1.0|REF99__V4|9526 | | | | |
| 13 | 1089 | B1.0|REF97__V4|127 | 1095 | B1.0|REF99__V4|54497 | 14 | 13 | 13 | 7 |
| 15 | 1191 | B1.0|REF97__V4|150716 | 1191 | B1.0|REF99__V4|150716 | 8 | 14 | 8 | 4 |
| 30 | 974 | B1.0|REF97__V4|2831 | 916 | B1.0|REF97__V4|3675 | | | | |
| 31 | 974 | B1.0|REF97__V4|2831 | 837 | B1.0|REF97__V4|720 | | | | |
| 33 | 974 | B1.0|REF97__V4|2831 | 137 | B1.0|REF99__V4|11 | | | | |
| 34 | 974 | B1.0|REF97__V4|2831 | 884 | B1.0|REF99__V4|1164 | | | | |
| 35 | 974 | B1.0|REF97__V4|2831 | 959 | B1.0|REF99__V4|126 | | | | |
| 36 | 974 | B1.0|REF97__V4|2831 | 886 | B1.0|REF99__V4|1287 | | | | |
| 37 | 974 | B1.0|REF97__V4|2831 | 71 | B1.0|REF99__V4|1351 | | | | |
| 40 | 974 | B1.0|REF97__V4|2831 | 116 | B1.0|REF99__V4|1567 | | | | |
| 41 | 974 | B1.0|REF97__V4|2831 | 1171 | B1.0|REF99__V4|1639 | | | | |
| 43 | 974 | B1.0|REF97__V4|2831 | 889 | B1.0|REF99__V4|185 | | | | |
| 45 | 974 | B1.0|REF97__V4|2831 | 1011 | B1.0|REF99__V4|2104 | | | | |
| 46 | 974 | B1.0|REF97__V4|2831 | 789 | B1.0|REF99__V4|2172 | | | | |
| 47 | 974 | B1.0|REF97__V4|2831 | 683 | B1.0|REF99__V4|2385 | | | | |
| 48 | 974 | B1.0|REF97__V4|2831 | 810 | B1.0|REF99__V4|250 | | | | |
| 49 | 974 | B1.0|REF97__V4|2831 | 131 | B1.0|REF99__V4|251 | | | | |
| 50 | 974 | B1.0|REF97__V4|2831 | 943 | B1.0|REF99__V4|26030 | | | | |
| 51 | 974 | B1.0|REF97__V4|2831 | 974 | B1.0|REF99__V4|2831 | | | | |
| 52 | 974 | B1.0|REF97__V4|2831 | 615 | B1.0|REF99__V4|3374 | | | | |
| 55 | 974 | B1.0|REF97__V4|2831 | 916 | B1.0|REF99__V4|3675 | | | | |
| 57 | 974 | B1.0|REF97__V4|2831 | 880 | B1.0|REF99__V4|472 | | | | |
| 60 | 974 | B1.0|REF97__V4|2831 | 1012 | B1.0|REF99__V4|597 | | | | |
| 62 | 974 | B1.0|REF97__V4|2831 | 837 | B1.0|REF99__V4|720 | | | | |
| 63 | 974 | B1.0|REF97__V4|2831 | 713 | B1.0|REF99__V4|754 | | | | |
| 65 | 974 | B1.0|REF97__V4|2831 | 1007 | B1.0|REF99__V4|9526 | | | | |
| 74 | 916 | B1.0|REF97__V4|3675 | 837 | B1.0|REF97__V4|720 | | | | |
| 76 | 916 | B1.0|REF97__V4|3675 | 137 | B1.0|REF99__V4|11 | | | | |
| 78 | 916 | B1.0|REF97__V4|3675 | 959 | B1.0|REF99__V4|126 | | | | |
| 80 | 916 | B1.0|REF97__V4|3675 | 71 | B1.0|REF99__V4|1351 | | | | |
| 82 | 916 | B1.0|REF97__V4|3675 | 116 | B1.0|REF99__V4|1567 | | | | |
| 83 | 916 | B1.0|REF97__V4|3675 | 1171 | B1.0|REF99__V4|1639 | | | | |
| 85 | 916 | B1.0|REF97__V4|3675 | 1011 | B1.0|REF99__V4|2104 | | | | |
| 86 | 916 | B1.0|REF97__V4|3675 | 789 | B1.0|REF99__V4|2172 | | | | |
| 87 | 916 | B1.0|REF97__V4|3675 | 810 | B1.0|REF99__V4|250 | | | | |
| 89 | 916 | B1.0|REF97__V4|3675 | 943 | B1.0|REF99__V4|26030 | | | | |
| 90 | 916 | B1.0|REF97__V4|3675 | 974 | B1.0|REF99__V4|2831 | | | | |
| 91 | 916 | B1.0|REF97__V4|3675 | 615 | B1.0|REF99__V4|3374 | | | | |
| 93 | 916 | B1.0|REF97__V4|3675 | 916 | B1.0|REF99__V4|3675 | | | | |
| 95 | 916 | B1.0|REF97__V4|3675 | 880 | B1.0|REF99__V4|472 | | | | |
| 97 | 916 | B1.0|REF97__V4|3675 | 1012 | B1.0|REF99__V4|597 | | | | |
| 99 | 916 | B1.0|REF97__V4|3675 | 837 | B1.0|REF99__V4|720 | | | | |
| 100 | 916 | B1.0|REF97__V4|3675 | 713 | B1.0|REF99__V4|754 | | | | |
| 102 | 916 | B1.0|REF97__V4|3675 | 1007 | B1.0|REF99__V4|9526 | | | | |
| 104 | 1106 | B1.0|REF97__V4|66 | 1090 | B1.0|REF99__V4|79117 | | | | |
| 106 | 837 | B1.0|REF97__V4|720 | 137 | B1.0|REF99__V4|11 | | | | |

TABLE 16-continued

| | | | | | | | | |
|---|---|---|---|---|---|---|---|---|
| 107 | 837 | B1.0\|REF97__V4\|720 | 884 | B1.0\|REF99__V4\|1164 | | | | |
| 108 | 837 | B1.0\|REF97__V4\|720 | 959 | B1.0\|REF99__V4\|126 | | | | |
| 109 | 837 | B1.0\|REF97__V4\|720 | 71 | B1.0\|REF99__V4\|1351 | | | | |
| 110 | 837 | B1.0\|REF97__V4\|720 | 116 | B1.0\|REF99__V4\|1567 | | | | |
| 111 | 837 | B1.0\|REF97__V4\|720 | 1011 | B1.0\|REF99__V4\|2104 | | | | |
| 112 | 837 | B1.0\|REF97__V4\|720 | 789 | B1.0\|REF99__V4\|2172 | | | | |
| 113 | 837 | B1.0\|REF97__V4\|720 | 810 | B1.0\|REF99__V4\|250 | | | | |
| 114 | 837 | B1.0\|REF97__V4\|720 | 943 | B1.0\|REF99__V4\|26030 | | | | |
| 115 | 837 | B1.0\|REF97__V4\|720 | 974 | B1.0\|REF99__V4\|2831 | | | | |
| 116 | 837 | B1.0\|REF97__V4\|720 | 615 | B1.0\|REF99__V4\|3374 | | | | |
| 118 | 837 | B1.0\|REF97__V4\|720 | 916 | B1.0\|REF99__V4\|3675 | | | | |
| 119 | 837 | B1.0\|REF97__V4\|720 | 880 | B1.0\|REF99__V4\|472 | | | | |
| 120 | 837 | B1.0\|REF97__V4\|720 | 1012 | B1.0\|REF99__V4\|597 | | | | |
| 121 | 837 | B1.0\|REF97__V4\|720 | 837 | B1.0\|REF99__V4\|720 | | | | |
| 124 | 837 | B1.0\|REF97__V4\|720 | 1007 | B1.0\|REF99__V4\|9526 | | | | |
| 125 | 510 | B1.0\|REF97__V4\|8981 | 510 | B1.0\|REF99__V4\|8981 | 8 | 9 | 8 | 3 |
| 135 | 1007 | B1.0\|REF97__V4\|9526 | 916 | B1.0\|REF99__V4\|3675 | | | | |
| 136 | 1007 | B1.0\|REF97__V4\|9526 | 1012 | B1.0\|REF99__V4\|597 | | | | |
| 139 | 372 | B1.0\|REF99__V4\|10206 | 881 | B1.0\|REF99__V4\|434 | | | | |
| 146 | 137 | B1.0\|REF99__V4\|11 | 959 | B1.0\|REF99__V4\|126 | | | | |
| 147 | 137 | B1.0\|REF99__V4\|11 | 71 | B1.0\|REF99__V4\|1351 | | | | |
| 148 | 137 | B1.0\|REF99__V4\|11 | 116 | B1.0\|REF99__V4\|1567 | | | | |
| 151 | 137 | B1.0\|REF99__V4\|11 | 1011 | B1.0\|REF99__V4\|2104 | | | | |
| 152 | 137 | B1.0\|REF99__V4\|11 | 789 | B1.0\|REF99__V4\|2172 | | | | |
| 153 | 137 | B1.0\|REF99__V4\|11 | 810 | B1.0\|REF99__V4\|250 | | | | |
| 154 | 137 | B1.0\|REF99__V4\|11 | 943 | B1.0\|REF99__V4\|26030 | | | | |
| 155 | 137 | B1.0\|REF99__V4\|11 | 974 | B1.0\|REF99__V4\|2831 | | | | |
| 156 | 137 | B1.0\|REF99__V4\|11 | 615 | B1.0\|REF99__V4\|3374 | | | | |
| 158 | 137 | B1.0\|REF99__V4\|11 | 916 | B1.0\|REF99__V4\|3675 | | | | |
| 159 | 137 | B1.0\|REF99__V4\|11 | 880 | B1.0\|REF99__V4\|472 | | | | |
| 161 | 137 | B1.0\|REF99__V4\|11 | 1012 | B1.0\|REF99__V4\|597 | | | | |
| 162 | 137 | B1.0\|REF99__V4\|11 | 837 | B1.0\|REF99__V4\|720 | | | | |
| 163 | 137 | B1.0\|REF99__V4\|11 | 713 | B1.0\|REF99__V4\|754 | | | | |
| 165 | 137 | B1.0\|REF99__V4\|11 | 1007 | B1.0\|REF99__V4\|9526 | | | | |
| 172 | 884 | B1.0\|REF99__V4\|1164 | 974 | B1.0\|REF99__V4\|2831 | | | | |
| 174 | 884 | B1.0\|REF99__V4\|1164 | 916 | B1.0\|REF99__V4\|3675 | | | | |
| 179 | 959 | B1.0\|REF99__V4\|126 | 71 | B1.0\|REF99__V4\|1351 | | | | |
| 181 | 959 | B1.0\|REF99__V4\|126 | 116 | B1.0\|REF99__V4\|1567 | | | | |
| 184 | 959 | B1.0\|REF99__V4\|126 | 1011 | B1.0\|REF99__V4\|2104 | | | | |
| 185 | 959 | B1.0\|REF99__V4\|126 | 789 | B1.0\|REF99__V4\|2172 | | | | |
| 186 | 959 | B1.0\|REF99__V4\|126 | 810 | B1.0\|REF99__V4\|250 | | | | |
| 188 | 959 | B1.0\|REF99__V4\|126 | 943 | B1.0\|REF99__V4\|26030 | | | | |
| 189 | 959 | B1.0\|REF99__V4\|126 | 974 | B1.0\|REF99__V4\|2831 | | | | |
| 190 | 959 | B1.0\|REF99__V4\|126 | 615 | B1.0\|REF99__V4\|3374 | | | | |
| 193 | 959 | B1.0\|REF99__V4\|126 | 916 | B1.0\|REF99__V4\|3675 | | | | |
| 195 | 959 | B1.0\|REF99__V4\|126 | 880 | B1.0\|REF99__V4\|472 | | | | |
| 197 | 959 | B1.0\|REF99__V4\|126 | 1012 | B1.0\|REF99__V4\|597 | | | | |
| 198 | 959 | B1.0\|REF99__V4\|126 | 837 | B1.0\|REF99__V4\|720 | | | | |
| 199 | 959 | B1.0\|REF99__V4\|126 | 713 | B1.0\|REF99__V4\|754 | | | | |
| 201 | 959 | B1.0\|REF99__V4\|126 | 1007 | B1.0\|REF99__V4\|9526 | | | | |
| 202 | 886 | B1.0\|REF99__V4\|1287 | 974 | B1.0\|REF99__V4\|2831 | | | | |
| 205 | 71 | B1.0\|REF99__V4\|1351 | 116 | B1.0\|REF99__V4\|1567 | | | | |
| 206 | 71 | B1.0\|REF99__V4\|1351 | 1011 | B1.0\|REF99__V4\|2104 | | | | |
| 207 | 71 | B1.0\|REF99__V4\|1351 | 789 | B1.0\|REF99__V4\|2172 | | | | |
| 208 | 71 | B1.0\|REF99__V4\|1351 | 810 | B1.0\|REF99__V4\|250 | | | | |
| 210 | 71 | B1.0\|REF99__V4\|1351 | 943 | B1.0\|REF99__V4\|26030 | | | | |
| 211 | 71 | B1.0\|REF99__V4\|1351 | 974 | B1.0\|REF99__V4\|2831 | | | | |
| 212 | 71 | B1.0\|REF99__V4\|1351 | 615 | B1.0\|REF99__V4\|3374 | | | | |
| 214 | 71 | B1.0\|REF99__V4\|1351 | 916 | B1.0\|REF99__V4\|3675 | | | | |
| 215 | 71 | B1.0\|REF99__V4\|1351 | 880 | B1.0\|REF99__V4\|472 | | | | |
| 217 | 71 | B1.0\|REF99__V4\|1351 | 1012 | B1.0\|REF99__V4\|597 | | | | |
| 218 | 71 | B1.0\|REF99__V4\|1351 | 837 | B1.0\|REF99__V4\|720 | | | | |
| 221 | 71 | B1.0\|REF99__V4\|1351 | 1007 | B1.0\|REF99__V4\|9526 | | | | |
| 228 | 1112 | B1.0\|REF99__V4\|14460 | 1088 | B1.0\|REF99__V4\|1703 | | | | |
| 229 | 1112 | B1.0\|REF99__V4\|14460 | 1109 | B1.0\|REF99__V4\|25629 | | | | |
| 231 | 1112 | B1.0\|REF99__V4\|14460 | 1095 | B1.0\|REF99__V4\|54497 | 12 | 13 | 11 | 6 |
| 232 | 1091 | B1.0\|REF99__V4\|15 | 1080 | B1.0\|REF99__V4\|19 | | | | |
| 234 | 1091 | B1.0\|REF99__V4\|15 | 1086 | B1.0\|REF99__V4\|25794 | | | | |
| 235 | 1091 | B1.0\|REF99__V4\|15 | 1093 | B1.0\|REF99__V4\|29 | | | | |
| 236 | 1191 | B1.0\|REF99__V4\|150716 | 972 | B1.0\|REF99__V4\|218 | 14 | 12 | 9 | 6 |
| 237 | 1191 | B1.0\|REF99__V4\|150716 | 1163 | B1.0\|REF99__V4\|6806 | 14 | 16 | 12 | 8 |
| 240 | 1081 | B1.0\|REF99__V4\|156009 | 1086 | B1.0\|REF99__V4\|25794 | | | | |
| 241 | 1081 | B1.0\|REF99__V4\|156009 | 1093 | B1.0\|REF99__V4\|29 | | | | |
| 245 | 116 | B1.0\|REF99__V4\|1567 | 1011 | B1.0\|REF99__V4\|2104 | | | | |
| 246 | 116 | B1.0\|REF99__V4\|1567 | 789 | B1.0\|REF99__V4\|2172 | | | | |
| 247 | 116 | B1.0\|REF99__V4\|1567 | 810 | B1.0\|REF99__V4\|250 | | | | |
| 248 | 116 | B1.0\|REF99__V4\|1567 | 943 | B1.0\|REF99__V4\|26030 | | | | |
| 249 | 116 | B1.0\|REF99__V4\|1567 | 974 | B1.0\|REF99__V4\|2831 | | | | |
| 250 | 116 | B1.0\|REF99__V4\|1567 | 615 | B1.0\|REF99__V4\|3374 | | | | |
| 251 | 116 | B1.0\|REF99__V4\|1567 | 916 | B1.0\|REF99__V4\|3675 | | | | |

TABLE 16-continued

| | | | | | | | | | |
|---|---|---|---|---|---|---|---|---|---|
| 252 | 116 | B1.0|REF99__V4|1567 | 880 | B1.0|REF99__V4|472 | | | | |
| 254 | 116 | B1.0|REF99__V4|1567 | 1012 | B1.0|REF99__V4|597 | | | | |
| 255 | 116 | B1.0|REF99__V4|1567 | 837 | B1.0|REF99__V4|720 | | | | |
| 256 | 116 | B1.0|REF99__V4|1567 | 713 | B1.0|REF99__V4|754 | | | | |
| 258 | 116 | B1.0|REF99__V4|1567 | 1007 | B1.0|REF99__V4|9526 | | | | |
| 259 | 1097 | B1.0|REF99__V4|159716 | 1086 | B1.0|REF99__V4|25794 | | | | |
| 260 | 1171 | B1.0|REF99__V4|1639 | 943 | B1.0|REF99__V4|26030 | | | | |
| 261 | 1171 | B1.0|REF99__V4|1639 | 974 | B1.0|REF99__V4|2831 | | | | |
| 262 | 1171 | B1.0|REF99__V4|1639 | 916 | B1.0|REF99__V4|3675 | | | | |
| 267 | 1088 | B1.0|REF99__V4|1703 | 1109 | B1.0|REF99__V4|25629 | | | | |
| 269 | 889 | B1.0|REF99__V4|185 | 789 | B1.0|REF99__V4|2172 | | | | |
| 270 | 889 | B1.0|REF99__V4|185 | 974 | B1.0|REF99__V4|2831 | | | | |
| 271 | 889 | B1.0|REF99__V4|185 | 916 | B1.0|REF99__V4|3675 | | | | |
| 272 | 889 | B1.0|REF99__V4|185 | 1012 | B1.0|REF99__V4|597 | | | | |
| 273 | 1080 | B1.0|REF99__V4|19 | 1086 | B1.0|REF99__V4|25794 | | | | |
| 274 | 1080 | B1.0|REF99__V4|19 | 1093 | B1.0|REF99__V4|29 | | | | |
| 280 | 656 | B1.0|REF99__V4|191 | 713 | B1.0|REF99__V4|754 | | | | |
| 283 | 1195 | B1.0|REF99__V4|1916 | 881 | B1.0|REF99__V4|434 | | | | |
| 286 | 1011 | B1.0|REF99__V4|2104 | 789 | B1.0|REF99__V4|2172 | | | | |
| 287 | 1011 | B1.0|REF99__V4|2104 | 810 | B1.0|REF99__V4|250 | | | | |
| 289 | 1011 | B1.0|REF99__V4|2104 | 943 | B1.0|REF99__V4|26030 | | | | |
| 290 | 1011 | B1.0|REF99__V4|2104 | 974 | B1.0|REF99__V4|2831 | | | | |
| 291 | 1011 | B1.0|REF99__V4|2104 | 615 | B1.0|REF99__V4|3374 | | | | |
| 293 | 1011 | B1.0|REF99__V4|2104 | 916 | B1.0|REF99__V4|3675 | | | | |
| 294 | 1011 | B1.0|REF99__V4|2104 | 880 | B1.0|REF99__V4|472 | | | | |
| 296 | 1011 | B1.0|REF99__V4|2104 | 1012 | B1.0|REF99__V4|597 | | | | |
| 297 | 1011 | B1.0|REF99__V4|2104 | 837 | B1.0|REF99__V4|720 | | | | |
| 300 | 1011 | B1.0|REF99__V4|2104 | 1007 | B1.0|REF99__V4|9526 | | | | |
| 301 | 789 | B1.0|REF99__V4|2172 | 810 | B1.0|REF99__V4|250 | | | | |
| 303 | 789 | B1.0|REF99__V4|2172 | 943 | B1.0|REF99__V4|26030 | | | | |
| 304 | 789 | B1.0|REF99__V4|2172 | 974 | B1.0|REF99__V4|2831 | | | | |
| 305 | 789 | B1.0|REF99__V4|2172 | 615 | B1.0|REF99__V4|3374 | | | | |
| 307 | 789 | B1.0|REF99__V4|2172 | 916 | B1.0|REF99__V4|3675 | | | | |
| 308 | 789 | B1.0|REF99__V4|2172 | 880 | B1.0|REF99__V4|472 | | | | |
| 310 | 789 | B1.0|REF99__V4|2172 | 1012 | B1.0|REF99__V4|597 | | | | |
| 311 | 789 | B1.0|REF99__V4|2172 | 837 | B1.0|REF99__V4|720 | | | | |
| 312 | 789 | B1.0|REF99__V4|2172 | 713 | B1.0|REF99__V4|754 | | | | |
| 314 | 789 | B1.0|REF99__V4|2172 | 1007 | B1.0|REF99__V4|9526 | | | | |
| 315 | 972 | B1.0|REF99__V4|218 | 957 | B1.0|REF99__V4|921 | 12 | 7 | 6 | 3 |
| 317 | 683 | B1.0|REF99__V4|2385 | 974 | B1.0|REF99__V4|2831 | | | | |
| 318 | 683 | B1.0|REF99__V4|2385 | 1012 | B1.0|REF99__V4|597 | | | | |
| 319 | 810 | B1.0|REF99__V4|250 | 943 | B1.0|REF99__V4|26030 | | | | |
| 320 | 810 | B1.0|REF99__V4|250 | 974 | B1.0|REF99__V4|2831 | | | | |
| 321 | 810 | B1.0|REF99__V4|250 | 615 | B1.0|REF99__V4|3374 | | | | |
| 322 | 810 | B1.0|REF99__V4|250 | 916 | B1.0|REF99__V4|3675 | | | | |
| 323 | 810 | B1.0|REF99__V4|250 | 880 | B1.0|REF99__V4|472 | | | | |
| 324 | 810 | B1.0|REF99__V4|250 | 1012 | B1.0|REF99__V4|597 | | | | |
| 325 | 810 | B1.0|REF99__V4|250 | 837 | B1.0|REF99__V4|720 | | | | |
| 328 | 810 | B1.0|REF99__V4|250 | 1007 | B1.0|REF99__V4|9526 | | | | |
| 329 | 131 | B1.0|REF99__V4|251 | 974 | B1.0|REF99__V4|2831 | | | | |
| 335 | 131 | B1.0|REF99__V4|251 | 1007 | B1.0|REF99__V4|9526 | | | | |
| 337 | 1086 | B1.0|REF99__V4|25794 | 1093 | B1.0|REF99__V4|29 | | | | |
| 338 | 943 | B1.0|REF99__V4|26030 | 974 | B1.0|REF99__V4|2831 | | | | |
| 339 | 943 | B1.0|REF99__V4|26030 | 615 | B1.0|REF99__V4|3374 | | | | |
| 341 | 943 | B1.0|REF99__V4|26030 | 916 | B1.0|REF99__V4|3675 | | | | |
| 342 | 943 | B1.0|REF99__V4|26030 | 880 | B1.0|REF99__V4|472 | | | | |
| 344 | 943 | B1.0|REF99__V4|26030 | 1012 | B1.0|REF99__V4|597 | | | | |
| 345 | 943 | B1.0|REF99__V4|26030 | 837 | B1.0|REF99__V4|720 | | | | |
| 348 | 943 | B1.0|REF99__V4|26030 | 1007 | B1.0|REF99__V4|9526 | | | | |
| 349 | 974 | B1.0|REF99__V4|2831 | 615 | B1.0|REF99__V4|3374 | | | | |
| 352 | 974 | B1.0|REF99__V4|2831 | 916 | B1.0|REF99__V4|3675 | | | | |
| 354 | 974 | B1.0|REF99__V4|2831 | 880 | B1.0|REF99__V4|472 | | | | |
| 357 | 974 | B1.0|REF99__V4|2831 | 1012 | B1.0|REF99__V4|597 | | | | |
| 359 | 974 | B1.0|REF99__V4|2831 | 837 | B1.0|REF99__V4|720 | | | | |
| 360 | 974 | B1.0|REF99__V4|2831 | 713 | B1.0|REF99__V4|754 | | | | |
| 362 | 974 | B1.0|REF99__V4|2831 | 1007 | B1.0|REF99__V4|9526 | | | | |
| 364 | 1175 | B1.0|REF99__V4|284 | 1199 | B1.0|REF99__V4|589 | 11 | 5 | 5 | 2 |
| 366 | 615 | B1.0|REF99__V4|3374 | 916 | B1.0|REF99__V4|3675 | | | | |
| 367 | 615 | B1.0|REF99__V4|3374 | 880 | B1.0|REF99__V4|472 | | | | |
| 369 | 615 | B1.0|REF99__V4|3374 | 1012 | B1.0|REF99__V4|597 | | | | |
| 370 | 615 | B1.0|REF99__V4|3374 | 837 | B1.0|REF99__V4|720 | | | | |
| 371 | 615 | B1.0|REF99__V4|3374 | 713 | B1.0|REF99__V4|754 | | | | |
| 373 | 615 | B1.0|REF99__V4|3374 | 1007 | B1.0|REF99__V4|9526 | | | | |
| 379 | 916 | B1.0|REF99__V4|3675 | 880 | B1.0|REF99__V4|472 | | | | |
| 381 | 916 | B1.0|REF99__V4|3675 | 1012 | B1.0|REF99__V4|597 | | | | |
| 383 | 916 | B1.0|REF99__V4|3675 | 837 | B1.0|REF99__V4|720 | | | | |
| 384 | 916 | B1.0|REF99__V4|3675 | 713 | B1.0|REF99__V4|754 | | | | |
| 386 | 916 | B1.0|REF99__V4|3675 | 1007 | B1.0|REF99__V4|9526 | | | | |
| 389 | 880 | B1.0|REF99__V4|472 | 1012 | B1.0|REF99__V4|597 | | | | |
| 390 | 880 | B1.0|REF99__V4|472 | 837 | B1.0|REF99__V4|720 | | | | |

TABLE 16-continued

| | | | | | | | | | |
|---|---|---|---|---|---|---|---|---|---|
| 392 | 880 | B1.0\|REF99__V4\|472 | 1007 | B1.0\|REF99__V4\|9526 | | | | | |
| 398 | 818 | B1.0\|REF99__V4\|531 | 837 | B1.0\|REF99__V4\|720 | | | | | |
| 400 | 1012 | B1.0\|REF99__V4\|597 | 837 | B1.0\|REF99__V4\|720 | | | | | |
| 401 | 1012 | B1.0\|REF99__V4\|597 | 713 | B1.0\|REF99__V4\|754 | | | | | |
| 403 | 1012 | B1.0\|REF99__V4\|597 | 1007 | B1.0\|REF99__V4\|9526 | | | | | |
| 407 | 837 | B1.0\|REF99__V4\|720 | 1007 | B1.0\|REF99__V4\|9526 | | | | | |
| 409 | 713 | B1.0\|REF99__V4\|754 | 1007 | B1.0\|REF99__V4\|9526 | | | | | |
| 411 | 1108 | B1.0\|REF97__V4\|1 | 1099 | B1.0\|REF99__V4\|11708 | 7 | 8 | 5 | 2 | |
| 412 | 1108 | B1.0\|REF97__V4\|1 | 1088 | B1.0\|REF99__V4\|1703 | 7 | 13 | 7 | 3 | |
| 413 | 1108 | B1.0\|REF97__V4\|1 | 1113 | B1.0\|REF99__V4\|52497 | 7 | 8 | 7 | 2 | |
| 414 | 499 | B1.0\|REF97__V4\|1098 | 527 | B1.0\|REF97__V4\|66392 | 4 | 8 | 4 | 1 | |
| 415 | 499 | B1.0\|REF97__V4\|1098 | 957 | B1.0\|REF99__V4\|921 | 4 | 7 | 4 | 1 | |
| 416 | 1089 | B1.0\|REF97__V4\|127 | 1098 | B1.0\|REF97__V4\|171 | 14 | 6 | 6 | 3 | |
| 417 | 1089 | B1.0\|REF97__V4\|127 | 527 | B1.0\|REF97__V4\|66392 | 14 | 8 | 7 | 4 | |
| 418 | 1089 | B1.0\|REF97__V4\|127 | 510 | B1.0\|REF97__V4\|8981 | 14 | 8 | 7 | 4 | |
| 419 | 1089 | B1.0\|REF97__V4\|127 | 499 | B1.0\|REF99__V4\|1098 | 14 | 11 | 9 | 6 | |
| 420 | 1089 | B1.0\|REF97__V4\|127 | 1104 | B1.0\|REF99__V4\|122519 | 14 | 7 | 7 | 4 | |
| 421 | 1089 | B1.0\|REF97__V4\|127 | 1112 | B1.0\|REF99__V4\|14460 | 14 | 12 | 12 | 6 | |
| 422 | 1089 | B1.0\|REF97__V4\|127 | 1175 | B1.0\|REF99__V4\|284 | 14 | 11 | 9 | 6 | |
| 423 | 1089 | B1.0\|REF97__V4\|127 | 1105 | B1.0\|REF99__V4\|4080 | 14 | 8 | 7 | 4 | |
| 424 | 1089 | B1.0\|REF97__V4\|127 | 702 | B1.0\|REF99__V4\|5579 | 14 | 21 | 14 | 11 | |
| 425 | 1089 | B1.0\|REF97__V4\|127 | 527 | B1.0\|REF99__V4\|66392 | 14 | 11 | 9 | 6 | |
| 426 | 1089 | B1.0\|REF97__V4\|127 | 942 | B1.0\|REF99__V4\|825 | 14 | 14 | 10 | 7 | |
| 427 | 1191 | B1.0\|REF97__V4\|150716 | 527 | B1.0\|REF99__V4\|66392 | 8 | 11 | 7 | 3 | |
| 428 | 1098 | B1.0\|REF97__V4\|171 | 510 | B1.0\|REF97__V4\|8981 | 6 | 8 | 5 | 2 | |
| 429 | 1098 | B1.0\|REF97__V4\|171 | 1104 | B1.0\|REF99__V4\|122519 | 6 | 7 | 6 | 2 | |
| 430 | 1098 | B1.0\|REF97__V4\|171 | 1112 | B1.0\|REF99__V4\|14460 | 6 | 12 | 6 | 3 | |
| 431 | 1098 | B1.0\|REF97__V4\|171 | 1098 | B1.0\|REF99__V4\|171 | 6 | 15 | 6 | 3 | |
| 432 | 1098 | B1.0\|REF97__V4\|171 | 1105 | B1.0\|REF99__V4\|4080 | 6 | 8 | 6 | 2 | |
| 433 | 1098 | B1.0\|REF97__V4\|171 | 1201 | B1.0\|REF99__V4\|42 | 6 | 10 | 5 | 2 | |
| 434 | 1098 | B1.0\|REF97__V4\|171 | 1106 | B1.0\|REF99__V4\|66 | 6 | 13 | 6 | 3 | |
| 435 | 1098 | B1.0\|REF97__V4\|171 | 510 | B1.0\|REF99__V4\|8981 | 6 | 9 | 5 | 2 | |
| 436 | 519 | B1.0\|REF97__V4\|35285 | 499 | B1.0\|REF99__V4\|1098 | 8 | 11 | 6 | 3 | |
| 437 | 519 | B1.0\|REF97__V4\|35285 | 1191 | B1.0\|REF99__V4\|150716 | 8 | 14 | 8 | 4 | |
| 438 | 519 | B1.0\|REF97__V4\|35285 | 1175 | B1.0\|REF99__V4\|284 | 8 | 11 | 6 | 3 | |
| 439 | 519 | B1.0\|REF97__V4\|35285 | 519 | B1.0\|REF99__V4\|35285 | 8 | 12 | 8 | 4 | |
| 440 | 519 | B1.0\|REF97__V4\|35285 | 527 | B1.0\|REF99__V4\|66392 | 8 | 11 | 6 | 3 | |
| 441 | 527 | B1.0\|REF97__V4\|66392 | 499 | B1.0\|REF99__V4\|1098 | 8 | 11 | 6 | 3 | |
| 442 | 527 | B1.0\|REF97__V4\|66392 | 982 | B1.0\|REF99__V4\|118 | 8 | 11 | 8 | 3 | |
| 443 | 527 | B1.0\|REF97__V4\|66392 | 1191 | B1.0\|REF99__V4\|150716 | 8 | 14 | 7 | 4 | |
| 444 | 527 | B1.0\|REF97__V4\|66392 | 972 | B1.0\|REF99__V4\|218 | 8 | 12 | 7 | 4 | |
| 445 | 527 | B1.0\|REF97__V4\|66392 | 527 | B1.0\|REF99__V4\|66392 | 8 | 11 | 8 | 3 | |
| 446 | 527 | B1.0\|REF97__V4\|66392 | 957 | B1.0\|REF99__V4\|921 | 8 | 7 | 7 | 2 | |
| 447 | 533 | B1.0\|REF97__V4\|69685 | 533 | B1.0\|REF99__V4\|69685 | 5 | 9 | 5 | 2 | |
| 448 | 510 | B1.0\|REF97__V4\|8981 | 499 | B1.0\|REF99__V4\|1098 | 8 | 11 | 6 | 3 | |
| 449 | 510 | B1.0\|REF97__V4\|8981 | 1104 | B1.0\|REF99__V4\|122519 | 8 | 7 | 6 | 2 | |
| 450 | 510 | B1.0\|REF97__V4\|8981 | 1112 | B1.0\|REF99__V4\|14460 | 8 | 12 | 7 | 4 | |
| 451 | 510 | B1.0\|REF97__V4\|8981 | 1105 | B1.0\|REF99__V4\|4080 | 8 | 8 | 6 | 2 | |
| 452 | 510 | B1.0\|REF97__V4\|8981 | 1201 | B1.0\|REF99__V4\|42 | 8 | 10 | 6 | 3 | |
| 453 | 510 | B1.0\|REF97__V4\|8981 | 942 | B1.0\|REF99__V4\|825 | 8 | 14 | 7 | 4 | |
| 454 | 492 | B1.0\|REF97__V4\|9806 | 533 | B1.0\|REF99__V4\|69685 | 5 | 9 | 5 | 2 | |
| 455 | 1108 | B1.0\|REF99__V4\|1 | 1110 | B1.0\|REF99__V4\|108549 | 17 | 8 | 8 | 5 | |
| 456 | 1108 | B1.0\|REF99__V4\|1 | 1099 | B1.0\|REF99__V4\|11708 | 17 | 8 | 8 | 5 | |
| 457 | 1108 | B1.0\|REF99__V4\|1 | 1088 | B1.0\|REF99__V4\|1703 | 17 | 13 | 11 | 8 | |
| 458 | 1108 | B1.0\|REF99__V4\|1 | 1105 | B1.0\|REF99__V4\|4080 | 17 | 8 | 8 | 5 | |
| 459 | 1108 | B1.0\|REF99__V4\|1 | 1201 | B1.0\|REF99__V4\|42 | 17 | 10 | 9 | 6 | |
| 460 | 1108 | B1.0\|REF99__V4\|1 | 1113 | B1.0\|REF99__V4\|52497 | 17 | 8 | 8 | 5 | |
| 461 | 1110 | B1.0\|REF99__V4\|108549 | 1099 | B1.0\|REF99__V4\|11708 | 8 | 8 | 6 | 2 | |
| 462 | 1110 | B1.0\|REF99__V4\|108549 | 1088 | B1.0\|REF99__V4\|1703 | 8 | 13 | 8 | 4 | |
| 463 | 1110 | B1.0\|REF99__V4\|108549 | 1201 | B1.0\|REF99__V4\|42 | 8 | 10 | 6 | 3 | |
| 464 | 1110 | B1.0\|REF99__V4\|108549 | 1113 | B1.0\|REF99__V4\|52497 | 8 | 8 | 7 | 2 | |
| 465 | 499 | B1.0\|REF99__V4\|1098 | 1099 | B1.0\|REF99__V4\|11708 | 11 | 8 | 6 | 3 | |
| 466 | 499 | B1.0\|REF99__V4\|1098 | 1175 | B1.0\|REF99__V4\|284 | 11 | 11 | 8 | 5 | |
| 467 | 499 | B1.0\|REF99__V4\|1098 | 519 | B1.0\|REF99__V4\|35285 | 11 | 12 | 10 | 5 | |
| 468 | 499 | B1.0\|REF99__V4\|1098 | 1201 | B1.0\|REF99__V4\|42 | 11 | 10 | 8 | 4 | |
| 469 | 499 | B1.0\|REF99__V4\|1098 | 1095 | B1.0\|REF99__V4\|54497 | 11 | 13 | 8 | 5 | |
| 470 | 1099 | B1.0\|REF99__V4\|11708 | 1201 | B1.0\|REF99__V4\|42 | 8 | 10 | 8 | 3 | |
| 471 | 1099 | B1.0\|REF99__V4\|11708 | 1113 | B1.0\|REF99__V4\|52497 | 8 | 8 | 6 | 2 | |
| 472 | 1099 | B1.0\|REF99__V4\|11708 | 1163 | B1.0\|REF99__V4\|6806 | 8 | 16 | 8 | 5 | |
| 473 | 982 | B1.0\|REF99__V4\|118 | 972 | B1.0\|REF99__V4\|218 | 11 | 12 | 10 | 5 | |
| 474 | 982 | B1.0\|REF99__V4\|118 | 527 | B1.0\|REF99__V4\|66392 | 11 | 11 | 9 | 5 | |
| 475 | 982 | B1.0\|REF99__V4\|118 | 957 | B1.0\|REF99__V4\|921 | 11 | 7 | 7 | 3 | |
| 476 | 535 | B1.0\|REF99__V4\|11976 | 478 | B1.0\|REF99__V4\|149 | 5 | 12 | 5 | 2 | |
| 477 | 535 | B1.0\|REF99__V4\|11976 | 496 | B1.0\|REF99__V4\|70 | 5 | 7 | 5 | 1 | |
| 478 | 1104 | B1.0\|REF99__V4\|122519 | 1112 | B1.0\|REF99__V4\|14460 | 7 | 12 | 7 | 3 | |
| 479 | 1104 | B1.0\|REF99__V4\|122519 | 1098 | B1.0\|REF99__V4\|171 | 7 | 15 | 7 | 4 | |
| 480 | 1104 | B1.0\|REF99__V4\|122519 | 1105 | B1.0\|REF99__V4\|4080 | 7 | 8 | 7 | 2 | |
| 481 | 1104 | B1.0\|REF99__V4\|122519 | 510 | B1.0\|REF99__V4\|8981 | 7 | 9 | 6 | 2 | |
| 482 | 537 | B1.0\|REF99__V4\|13031 | 496 | B1.0\|REF99__V4\|70 | 4 | 7 | 4 | 1 | |
| 483 | 1158 | B1.0\|REF99__V4\|1323 | 1191 | B1.0\|REF99__V4\|150716 | 8 | 14 | 7 | 4 | |

TABLE 16-continued

| | | | | | | | | |
|---|---|---|---|---|---|---|---|---|
| 484 | 1158 | B1.0\|REF99__V4\|1323 | 1163 | B1.0\|REF99__V4\|6806 | 8 | 16 | 8 | 5 |
| 485 | 1112 | B1.0\|REF99__V4\|14460 | 1191 | B1.0\|REF99__V4\|150716 | 12 | 14 | 9 | 6 |
| 486 | 1112 | B1.0\|REF99__V4\|14460 | 1105 | B1.0\|REF99__V4\|4080 | 12 | 8 | 7 | 4 |
| 487 | 1112 | B1.0\|REF99__V4\|14460 | 702 | B1.0\|REF99__V4\|5579 | 12 | 21 | 12 | 9 |
| 488 | 1112 | B1.0\|REF99__V4\|14460 | 527 | B1.0\|REF99__V4\|66392 | 12 | 11 | 8 | 5 |
| 489 | 1112 | B1.0\|REF99__V4\|14460 | 942 | B1.0\|REF99__V4\|825 | 12 | 14 | 9 | 6 |
| 490 | 1112 | B1.0\|REF99__V4\|14460 | 510 | B1.0\|REF99__V4\|8981 | 12 | 9 | 7 | 4 |
| 491 | 478 | B1.0\|REF99__V4\|149 | 702 | B1.0\|REF99__V4\|5579 | 12 | 21 | 12 | 9 |
| 492 | 478 | B1.0\|REF99__V4\|149 | 496 | B1.0\|REF99__V4\|70 | 12 | 7 | 7 | 3 |
| 493 | 1191 | B1.0\|REF99__V4\|150716 | 519 | B1.0\|REF99__V4\|35285 | 14 | 12 | 9 | 6 |
| 494 | 1191 | B1.0\|REF99__V4\|150716 | 702 | B1.0\|REF99__V4\|5579 | 14 | 21 | 14 | 11 |
| 495 | 1191 | B1.0\|REF99__V4\|150716 | 527 | B1.0\|REF99__V4\|66392 | 14 | 11 | 10 | 6 |
| 496 | 1088 | B1.0\|REF99__V4\|1703 | 1201 | B1.0\|REF99__V4\|42 | 13 | 10 | 8 | 5 |
| 497 | 1088 | B1.0\|REF99__V4\|1703 | 1113 | B1.0\|REF99__V4\|52497 | 13 | 8 | 7 | 4 |
| 498 | 1098 | B1.0\|REF99__V4\|171 | 1106 | B1.0\|REF99__V4\|66 | 15 | 13 | 11 | 7 |
| 499 | 972 | B1.0\|REF99__V4\|218 | 527 | B1.0\|REF99__V4\|66392 | 12 | 11 | 8 | 5 |
| 500 | 972 | B1.0\|REF99__V4\|218 | 516 | B1.0\|REF99__V4\|682 | 12 | 12 | 8 | 5 |
| 501 | 1175 | B1.0\|REF99__V4\|284 | 519 | B1.0\|REF99__V4\|35285 | 11 | 12 | 8 | 5 |
| 502 | 1175 | B1.0\|REF99__V4\|284 | 1095 | B1.0\|REF99__V4\|54497 | 11 | 13 | 9 | 5 |
| 503 | 519 | B1.0\|REF99__V4\|35285 | 1201 | B1.0\|REF99__V4\|42 | 12 | 10 | 8 | 4 |
| 504 | 519 | B1.0\|REF99__V4\|35285 | 527 | B1.0\|REF99__V4\|66392 | 12 | 11 | 8 | 5 |
| 505 | 519 | B1.0\|REF99__V4\|35285 | 1163 | B1.0\|REF99__V4\|6806 | 12 | 16 | 10 | 7 |
| 506 | 519 | B1.0\|REF99__V4\|35285 | 500 | B1.0\|REF99__V4\|806 | 12 | 6 | 6 | 3 |
| 507 | 519 | B1.0\|REF99__V4\|35285 | 510 | B1.0\|REF99__V4\|8981 | 12 | 9 | 7 | 4 |
| 508 | 1105 | B1.0\|REF99__V4\|4080 | 510 | B1.0\|REF99__V4\|8981 | 8 | 9 | 7 | 3 |
| 509 | 1201 | B1.0\|REF99__V4\|42 | 1113 | B1.0\|REF99__V4\|52497 | 10 | 8 | 6 | 3 |
| 510 | 1201 | B1.0\|REF99__V4\|42 | 1106 | B1.0\|REF99__V4\|66 | 10 | 13 | 8 | 5 |
| 511 | 1201 | B1.0\|REF99__V4\|42 | 1163 | B1.0\|REF99__V4\|6806 | 10 | 16 | 9 | 6 |
| 512 | 1201 | B1.0\|REF99__V4\|42 | 510 | B1.0\|REF99__V4\|8981 | 10 | 9 | 6 | 3 |
| 513 | 1095 | B1.0\|REF99__V4\|54497 | 702 | B1.0\|REF99__V4\|5579 | 13 | 21 | 13 | 10 |
| 514 | 1095 | B1.0\|REF99__V4\|54497 | 527 | B1.0\|REF99__V4\|66392 | 13 | 11 | 8 | 5 |
| 515 | 1095 | B1.0\|REF99__V4\|54497 | 942 | B1.0\|REF99__V4\|825 | 13 | 14 | 10 | 7 |
| 516 | 527 | B1.0\|REF99__V4\|66392 | 957 | B1.0\|REF99__V4\|921 | 11 | 7 | 7 | 3 |
| 517 | 1163 | B1.0\|REF99__V4\|6806 | 510 | B1.0\|REF99__V4\|8981 | 16 | 9 | 8 | 5 |
| 518 | 516 | B1.0\|REF99__V4\|682 | 957 | B1.0\|REF99__V4\|921 | 12 | 7 | 6 | 3 |
| 524 | 959 | B1.0\|REF97__V4\|126 | 810 | B1.0\|REF99__V4\|250 | | | | |
| 539 | 974 | B1.0\|REF97__V4\|2831 | 1012 | B1.0\|REF97__V4\|597 | | | | |
| 542 | 974 | B1.0\|REF97__V4\|2831 | 54 | B1.0\|REF99__V4\|118524 | | | | |
| 548 | 974 | B1.0\|REF97__V4\|2831 | 684 | B1.0\|REF99__V4\|172 | | | | |
| 558 | 916 | B1.0\|REF97__V4\|3675 | 1012 | B1.0\|REF97__V4\|597 | | | | |
| 560 | 916 | B1.0\|REF97__V4\|3675 | 54 | B1.0\|REF99__V4\|118524 | | | | |
| 565 | 916 | B1.0\|REF97__V4\|3675 | 684 | B1.0\|REF99__V4\|172 | | | | |
| 572 | 1012 | B1.0\|REF97__V4\|597 | 959 | B1.0\|REF99__V4\|126 | | | | |
| 575 | 1012 | B1.0\|REF97__V4\|597 | 810 | B1.0\|REF99__V4\|250 | | | | |
| 576 | 1012 | B1.0\|REF97__V4\|597 | 974 | B1.0\|REF99__V4\|2831 | | | | |
| 579 | 1012 | B1.0\|REF97__V4\|597 | 1012 | B1.0\|REF99__V4\|597 | | | | |
| 589 | 837 | B1.0\|REF97__V4\|720 | 121 | B1.0\|REF99__V4\|1211 | | | | |
| 594 | 837 | B1.0\|REF97__V4\|720 | 684 | B1.0\|REF99__V4\|172 | | | | |
| 603 | 837 | B1.0\|REF97__V4\|720 | 818 | B1.0\|REF99__V4\|531 | | | | |
| 622 | 137 | B1.0\|REF99__V4\|11 | 684 | B1.0\|REF99__V4\|172 | | | | |
| 655 | 54 | B1.0\|REF99__V4\|118524 | 959 | B1.0\|REF99__V4\|126 | | | | |
| 659 | 54 | B1.0\|REF99__V4\|118524 | 974 | B1.0\|REF99__V4\|2831 | | | | |
| 660 | 54 | B1.0\|REF99__V4\|118524 | 916 | B1.0\|REF99__V4\|3675 | | | | |
| 661 | 54 | B1.0\|REF99__V4\|118524 | 1012 | B1.0\|REF99__V4\|597 | | | | |
| 672 | 121 | B1.0\|REF99__V4\|1211 | 681 | B1.0\|REF99__V4\|234 | | | | |
| 674 | 121 | B1.0\|REF99__V4\|1211 | 837 | B1.0\|REF99__V4\|720 | | | | |
| 683 | 959 | B1.0\|REF99__V4\|126 | 684 | B1.0\|REF99__V4\|172 | | | | |
| 719 | 71 | B1.0\|REF99__V4\|1351 | 684 | B1.0\|REF99__V4\|172 | | | | |
| 738 | 1112 | B1.0\|REF99__V4\|14460 | 1086 | B1.0\|REF99__V4\|25794 | | | | |
| 740 | 116 | B1.0\|REF99__V4\|1567 | 1171 | B1.0\|REF99__V4\|1639 | | | | |
| 746 | 1171 | B1.0\|REF99__V4\|1639 | 789 | B1.0\|REF99__V4\|2172 | | | | |
| 747 | 1171 | B1.0\|REF99__V4\|1639 | 810 | B1.0\|REF99__V4\|250 | | | | |
| 748 | 1171 | B1.0\|REF99__V4\|1639 | 1012 | B1.0\|REF99__V4\|597 | | | | |
| 764 | 684 | B1.0\|REF99__V4\|172 | 789 | B1.0\|REF99__V4\|2172 | | | | |
| 766 | 684 | B1.0\|REF99__V4\|172 | 810 | B1.0\|REF99__V4\|250 | | | | |
| 767 | 684 | B1.0\|REF99__V4\|172 | 974 | B1.0\|REF99__V4\|2831 | | | | |
| 768 | 684 | B1.0\|REF99__V4\|172 | 615 | B1.0\|REF99__V4\|3374 | | | | |
| 769 | 684 | B1.0\|REF99__V4\|172 | 916 | B1.0\|REF99__V4\|3675 | | | | |
| 770 | 684 | B1.0\|REF99__V4\|172 | 880 | B1.0\|REF99__V4\|472 | | | | |
| 771 | 684 | B1.0\|REF99__V4\|172 | 1012 | B1.0\|REF99__V4\|597 | | | | |
| 772 | 684 | B1.0\|REF99__V4\|172 | 837 | B1.0\|REF99__V4\|720 | | | | |
| 773 | 684 | B1.0\|REF99__V4\|172 | 1007 | B1.0\|REF99__V4\|9526 | | | | |
| 778 | 889 | B1.0\|REF99__V4\|185 | 1011 | B1.0\|REF99__V4\|2104 | | | | |
| 782 | 889 | B1.0\|REF99__V4\|185 | 1007 | B1.0\|REF99__V4\|9526 | | | | |
| 830 | 131 | B1.0\|REF99__V4\|251 | 880 | B1.0\|REF99__V4\|472 | | | | |
| 933 | 1108 | B1.0\|REF97__V4\|1 | 1086 | B1.0\|REF99__V4\|25794 | | | | |
| 1036 | 1108 | B1.0\|REF97__V4\|1 | 1097 | B1.0\|REF99__V4\|159716 | | | | |
| 1070 | 1097 | B1.0\|REF99__V4\|159716 | 1093 | B1.0\|REF99__V4\|29 | | | | |
| 1938 | 982 | B1.0\|REF99__V4\|118 | 1195 | B1.0\|REF99__V4\|1916 | | | | |
| 1943 | 982 | B1.0\|REF99__V4\|118 | 881 | B1.0\|REF99__V4\|434 | | | | |

TABLE 16-continued

| | | | | |
|---|---|---|---|---|
| 2052 | 684 | B1.0|REF99__V4|172 | 1011 | B1.0|REF99__V4|2104 |
| 2290 | 137 | B1.0|REF99__V4|11 | 889 | B1.0|REF99__V4|185 |
| 2341 | 959 | B1.0|REF99__V4|126 | 889 | B1.0|REF99__V4|185 |
| 2402 | 889 | B1.0|REF99__V4|185 | 943 | B1.0|REF99__V4|26030 |
| 2745 | 137 | B1.0|REF99__V4|11 | 1171 | B1.0|REF99__V4|1639 |
| 3121 | 1091 | B1.0|REF99__V4|15 | 1081 | B1.0|REF99__V4|156009 |
| 3123 | 1091 | B1.0|REF99__V4|15 | 1088 | B1.0|REF99__V4|1703 |
| 3124 | 1081 | B1.0|REF99__V4|156009 | 1097 | B1.0|REF99__V4|159716 |
| 3125 | 1081 | B1.0|REF99__V4|156009 | 1080 | B1.0|REF99__V4|19 |
| 3126 | 1081 | B1.0|REF99__V4|156009 | 1083 | B1.0|REF99__V4|26074 |
| 3127 | 1097 | B1.0|REF99__V4|159716 | 1080 | B1.0|REF99__V4|19 |
| 3128 | 1097 | B1.0|REF99__V4|159716 | 1083 | B1.0|REF99__V4|26074 |
| 3129 | 1080 | B1.0|REF99__V4|19 | 1083 | B1.0|REF99__V4|26074 |
| 3131 | 1108 | B1.0|REF97__V4|1 | 1081 | B1.0|REF99__V4|156009 |
| 3132 | 137 | B1.0|REF97__V4|11 | 116 | B1.0|REF99__V4|1567 |
| 3133 | 974 | B1.0|REF97__V4|2831 | 121 | B1.0|REF99__V4|1211 |
| 3134 | 837 | B1.0|REF97__V4|720 | 1171 | B1.0|REF99__V4|1639 |
| 3135 | 372 | B1.0|REF99__V4|10206 | 1229 | B1.0|REF99__V4|1866 |
| 3136 | 850 | B1.0|REF99__V4|11157 | 684 | B1.0|REF99__V4|172 |
| 3137 | 121 | B1.0|REF99__V4|1211 | 684 | B1.0|REF99__V4|172 |
| 3138 | 121 | B1.0|REF99__V4|1211 | 974 | B1.0|REF99__V4|2831 |
| 3139 | 121 | B1.0|REF99__V4|1211 | 1012 | B1.0|REF99__V4|597 |
| 3140 | 959 | B1.0|REF99__V4|126 | 1171 | B1.0|REF99__V4|1639 |
| 3141 | 116 | B1.0|REF99__V4|1567 | 684 | B1.0|REF99__V4|172 |
| 3142 | 1171 | B1.0|REF99__V4|1639 | 1007 | B1.0|REF99__V4|9526 |
| 3143 | 684 | B1.0|REF99__V4|172 | 943 | B1.0|REF99__V4|26030 |
| 3144 | 137 | B1.0|REF97__V4|11 | 959 | B1.0|REF99__V4|126 |
| 3145 | 137 | B1.0|REF97__V4|11 | 810 | B1.0|REF99__V4|250 |
| 3146 | 54 | B1.0|REF99__V4|118524 | 116 | B1.0|REF99__V4|1567 |
| 3147 | 121 | B1.0|REF99__V4|1211 | 959 | B1.0|REF99__V4|126 |
| 3148 | 121 | B1.0|REF99__V4|1211 | 810 | B1.0|REF99__V4|250 |
| 3149 | 684 | B1.0|REF99__V4|172 | 719 | B1.0|REF99__V4|385 |
| 3150 | 684 | B1.0|REF99__V4|172 | 818 | B1.0|REF99__V4|531 |
| 3151 | 684 | B1.0|REF99__V4|172 | 430 | B1.0|REF99__V4|659 |
| 3152 | 1109 | B1.0|REF99__V4|25629 | 1086 | B1.0|REF99__V4|25794 |
| 3674 | 1673 | F1.0|SYM97__ITS1F|122 | 1515 | F1.0|SYM97__ITS1F|31 |
| 3675 | 1673 | F1.0|SYM97__ITS1F|122 | 1683 | F1.0|SYM97__ITS1F|51 |
| 3676 | 1673 | F1.0|SYM97__ITS1F|122 | 1682 | F1.0|SYM97__ITS1F|74 |
| 3678 | 1515 | F1.0|SYM97__ITS1F|31 | 1683 | F1.0|SYM97__ITS1F|51 |
| 3679 | 1515 | F1.0|SYM97__ITS1F|31 | 1682 | F1.0|SYM97__ITS1F|74 |
| 3680 | 1515 | F1.0|SYM97__ITS1F|31 | 1681 | F1.0|SYM97__ITS1F|75 |
| 3681 | 1515 | F1.0|SYM97__ITS1F|31 | 1574 | F1.0|U97__ITS1F|479 |
| 3682 | 1515 | F1.0|SYM97__ITS1F|31 | 1575 | F1.0|UDYN__ITS1F|37 |
| 3683 | 1515 | F1.0|SYM97__ITS1F|31 | 1573 | F1.0|UDYN__ITS1F|60 |
| 3684 | 1515 | F1.0|SYM97__ITS1F|31 | 1557 | F1.0|UDYN__ITS1F|621 |
| 3685 | 1683 | F1.0|SYM97__ITS1F|51 | 1682 | F1.0|SYM97__ITS1F|74 |
| 3686 | 1683 | F1.0|SYM97__ITS1F|51 | 1681 | F1.0|SYM97__ITS1F|75 |
| 3688 | 1683 | F1.0|SYM97__ITS1F|51 | 1557 | F1.0|UDYN__ITS1F|621 |
| 3690 | 1682 | F1.0|SYM97__ITS1F|74 | 1557 | F1.0|UDYN__ITS1F|621 |
| 3691 | 1574 | F1.0|U97__ITS1F|479 | 1575 | F1.0|UDYN__ITS1F|37 |
| 3693 | 1574 | F1.0|U97__ITS1F|479 | 1557 | F1.0|UDYN__ITS1F|621 |
| 3695 | 1575 | F1.0|UDYN__ITS1F|37 | 1573 | F1.0|UDYN__ITS1F|60 |
| 3696 | 1575 | F1.0|UDYN__ITS1F|37 | 1557 | F1.0|UDYN__ITS1F|621 |
| 3697 | 1672 | F1.0|UDYN__ITS1F|451 | 1655 | F1.0|UDYN__ITS1F|628 |
| 3698 | 1523 | F1.0|UDYN__ITS1F|486 | 1481 | F1.0|UDYN__ITS1F|548 |
| 3699 | 1523 | F1.0|UDYN__ITS1F|486 | 1581 | F1.0|UDYN__ITS1F|84 |
| 3700 | 1596 | F1.0|UDYN__ITS1F|508 | 1592 | F1.0|UDYN__ITS1F|627 |
| 3701 | 1596 | F1.0|UDYN__ITS1F|508 | 1581 | F1.0|UDYN__ITS1F|84 |
| 3702 | 1573 | F1.0|UDYN__ITS1F|60 | 1557 | F1.0|UDYN__ITS1F|621 |
| 3703 | 1515 | F1.0|SYM97__ITS1F|31 | 1650 | F1.0|SYM97__ITS1F|60 |
| 3704 | 1515 | F1.0|SYM97__ITS1F|31 | 1646 | F1.0|U97__ITS1F|106 |
| 3705 | 1515 | F1.0|SYM97__ITS1F|31 | 1647 | F1.0|U97__ITS1F|142 |
| 3706 | 1515 | F1.0|SYM97__ITS1F|31 | 1543 | F1.0|UDYN__ITS1F|353 |
| 3707 | 1515 | F1.0|SYM97__ITS1F|31 | 1690 | F1.0|UDYN__ITS1F|463 |
| 3708 | 1683 | F1.0|SYM97__ITS1F|51 | 1650 | F1.0|SYM97__ITS1F|60 |
| 3709 | 1683 | F1.0|SYM97__ITS1F|51 | 1646 | F1.0|U97__ITS1F|106 |
| 3710 | 1683 | F1.0|SYM97__ITS1F|51 | 1647 | F1.0|U97__ITS1F|142 |
| 3711 | 1683 | F1.0|SYM97__ITS1F|51 | 1543 | F1.0|UDYN__ITS1F|353 |
| 3712 | 1683 | F1.0|SYM97__ITS1F|51 | 1690 | F1.0|UDYN__ITS1F|463 |
| 3713 | 1650 | F1.0|SYM97__ITS1F|60 | 1682 | F1.0|SYM97__ITS1F|74 |
| 3714 | 1650 | F1.0|SYM97__ITS1F|60 | 1543 | F1.0|UDYN__ITS1F|353 |
| 3715 | 1682 | F1.0|SYM97__ITS1F|74 | 1681 | F1.0|SYM97__ITS1F|75 |
| 3716 | 1682 | F1.0|SYM97__ITS1F|74 | 1646 | F1.0|U97__ITS1F|106 |
| 3717 | 1682 | F1.0|SYM97__ITS1F|74 | 1647 | F1.0|U97__ITS1F|142 |
| 3718 | 1682 | F1.0|SYM97__ITS1F|74 | 1543 | F1.0|UDYN__ITS1F|353 |
| 3719 | 1682 | F1.0|SYM97__ITS1F|74 | 1690 | F1.0|UDYN__ITS1F|463 |
| 3720 | 1646 | F1.0|U97__ITS1F|106 | 1543 | F1.0|UDYN__ITS1F|353 |
| 3721 | 1647 | F1.0|U97__ITS1F|142 | 1543 | F1.0|UDYN__ITS1F|353 |
| 3722 | 1481 | F1.0|UDYN__ITS1F|548 | 1655 | F1.0|UDYN__ITS1F|628 |
| 3753 | 1690 | F1.0|UDYN__ITS1F|463 | 1557 | F1.0|UDYN__ITS1F|621 |

TABLE 16-continued

| | | | | | |
|---|---|---|---|---|---|
| 3757 | 1557 | F1.0\|UDYN__ITS1F\|621 | 1521 | F1.0\|UDYN__ITS1F\|73 | |
| 3764 | 1529 | F1.0\|U97__ITS1F\|80 | 1529 | F1.0\|UDYN__ITS1F\|80 | |
| 3769 | 1586 | F1.0\|UDYN__ITS1F\|110 | 1589 | F1.0\|UDYN__ITS1F\|83 | |
| 3895 | 1586 | F1.0\|UDYN__ITS1F\|110 | 1596 | F1.0\|UDYN__ITS1F\|508 | |
| 3896 | 1593 | F1.0\|UDYN__ITS1F\|16 | 1596 | F1.0\|UDYN__ITS1F\|508 | |
| 3897 | 1593 | F1.0\|UDYN__ITS1F\|16 | 1605 | F1.0\|UDYN__ITS1F\|6 | |
| 3898 | 1593 | F1.0\|UDYN__ITS1F\|16 | 1592 | F1.0\|UDYN__ITS1F\|627 | |
| 3901 | 1576 | F1.0\|UDYN__ITS1F\|112 | 1557 | F1.0\|UDYN__ITS1F\|621 | |
| 3902 | 1523 | F1.0\|UDYN__ITS1F\|486 | 1596 | F1.0\|UDYN__ITS1F\|508 | |
| 3903 | 1481 | F1.0\|UDYN__ITS1F\|548 | 1581 | F1.0\|UDYN__ITS1F\|84 | |
| 3904 | 1592 | F1.0\|UDYN__ITS1F\|627 | 1581 | F1.0\|UDYN__ITS1F\|84 | |

| A | G Fungi - Brassicaceae | | | | H Bacteria - Poaceae | | | | I Fungi - Poaceae | | | |
|---|---|---|---|---|---|---|---|---|---|---|---|---|
| PAIR | N1 | N2 | OC | EC | N1 | N2 | OC | EC | N1 | N2 | OC | EC |
| 1 | | | | | | | | | | | | |
| 2 | | | | | 42 | 41 | 31 | 11 | | | | |
| 3 | | | | | 42 | 41 | 32 | 11 | | | | |
| 4 | | | | | 36 | 42 | 27 | 9 | | | | |
| 5 | | | | | 36 | 37 | 25 | 8 | | | | |
| 6 | | | | | 36 | 64 | 34 | 14 | | | | |
| 8 | | | | | 36 | 52 | 29 | 12 | | | | |
| 9 | | | | | 36 | 42 | 27 | 9 | | | | |
| 10 | | | | | 36 | 40 | 26 | 9 | | | | |
| 11 | | | | | 36 | 39 | 26 | 9 | | | | |
| 12 | | | | | 36 | 43 | 26 | 10 | | | | |
| 13 | | | | | | | | | | | | |
| 15 | | | | | 28 | 29 | 25 | 5 | | | | |
| 30 | | | | | 42 | 37 | 37 | 10 | | | | |
| 31 | | | | | 42 | 42 | 37 | 11 | | | | |
| 33 | | | | | 42 | 64 | 41 | 17 | | | | |
| 34 | | | | | 42 | 23 | 23 | 6 | | | | |
| 35 | | | | | 42 | 39 | 39 | 10 | | | | |
| 36 | | | | | 42 | 22 | 22 | 6 | | | | |
| 37 | | | | | 42 | 36 | 34 | 9 | | | | |
| 40 | | | | | 42 | 39 | 35 | 10 | | | | |
| 41 | | | | | 42 | 27 | 27 | 7 | | | | |
| 43 | | | | | 42 | 35 | 28 | 9 | | | | |
| 45 | | | | | 42 | 30 | 30 | 8 | | | | |
| 46 | | | | | 42 | 52 | 39 | 14 | | | | |
| 47 | | | | | 42 | 22 | 22 | 6 | | | | |
| 48 | | | | | 42 | 35 | 35 | 9 | | | | |
| 49 | | | | | 42 | 33 | 26 | 9 | | | | |
| 50 | | | | | 42 | 33 | 33 | 9 | | | | |
| 51 | | | | | 42 | 42 | 42 | 11 | | | | |
| 52 | | | | | 42 | 32 | 32 | 8 | | | | |
| 55 | | | | | 42 | 40 | 40 | 10 | | | | |
| 57 | | | | | 42 | 42 | 33 | 11 | | | | |
| 60 | | | | | 42 | 39 | 39 | 10 | | | | |
| 62 | | | | | 42 | 66 | 42 | 17 | | | | |
| 63 | | | | | 42 | 39 | 30 | 10 | | | | |
| 65 | | | | | 42 | 43 | 38 | 11 | | | | |
| 74 | | | | | 37 | 42 | 33 | 10 | | | | |
| 76 | | | | | 37 | 64 | 36 | 15 | | | | |
| 78 | | | | | 37 | 39 | 35 | 9 | | | | |
| 80 | | | | | 37 | 36 | 30 | 8 | | | | |
| 82 | | | | | 37 | 39 | 32 | 9 | | | | |
| 83 | | | | | 37 | 27 | 25 | 6 | | | | |
| 85 | | | | | 37 | 30 | 29 | 7 | | | | |
| 86 | | | | | 37 | 52 | 35 | 12 | | | | |
| 87 | | | | | 37 | 35 | 31 | 8 | | | | |
| 89 | | | | | 37 | 33 | 32 | 8 | | | | |
| 90 | | | | | 37 | 42 | 37 | 10 | | | | |
| 91 | | | | | 37 | 32 | 28 | 7 | | | | |
| 93 | | | | | 37 | 40 | 37 | 9 | | | | |
| 95 | | | | | 37 | 42 | 29 | 10 | | | | |
| 97 | | | | | 37 | 39 | 34 | 9 | | | | |
| 99 | | | | | 37 | 66 | 37 | 15 | | | | |
| 100 | | | | | 37 | 39 | 26 | 9 | | | | |
| 102 | | | | | 37 | 43 | 34 | 10 | | | | |
| 104 | | | | | 85 | 71 | 62 | 38 | | | | |
| 106 | | | | | 42 | 64 | 36 | 17 | | | | |
| 107 | | | | | 42 | 23 | 23 | 6 | | | | |
| 108 | | | | | 42 | 39 | 34 | 10 | | | | |
| 109 | | | | | 42 | 36 | 29 | 9 | | | | |
| 110 | | | | | 42 | 39 | 30 | 10 | | | | |
| 111 | | | | | 42 | 30 | 25 | 8 | | | | |

TABLE 16-continued

| | | | | |
|---|---|---|---|---|
| 112 | 42 | 52 | 34 | 14 |
| 113 | 42 | 35 | 33 | 9 |
| 114 | 42 | 33 | 29 | 9 |
| 115 | 42 | 42 | 37 | 11 |
| 116 | 42 | 32 | 28 | 8 |
| 118 | 42 | 40 | 35 | 10 |
| 119 | 42 | 42 | 29 | 11 |
| 120 | 42 | 39 | 35 | 10 |
| 121 | 42 | 66 | 42 | 17 |
| 124 | 42 | 43 | 33 | 11 |
| 125 | 28 | 33 | 27 | 6 |
| 135 | 23 | 40 | 22 | 6 |
| 136 | 23 | 39 | 22 | 6 |
| 139 | 81 | 74 | 56 | 37 |
| 146 | 64 | 39 | 38 | 16 |
| 147 | 64 | 36 | 33 | 14 |
| 148 | 64 | 39 | 36 | 16 |
| 151 | 64 | 30 | 29 | 12 |
| 152 | 64 | 52 | 42 | 21 |
| 153 | 64 | 35 | 34 | 14 |
| 154 | 64 | 33 | 32 | 13 |
| 155 | 64 | 42 | 41 | 17 |
| 156 | 64 | 32 | 31 | 13 |
| 158 | 64 | 40 | 39 | 16 |
| 159 | 64 | 42 | 39 | 17 |
| 161 | 64 | 39 | 38 | 16 |
| 162 | 64 | 66 | 48 | 26 |
| 163 | 64 | 39 | 32 | 16 |
| 165 | 64 | 43 | 38 | 17 |
| 172 | 23 | 42 | 23 | 6 |
| 174 | 23 | 40 | 22 | 6 |
| 179 | 39 | 36 | 32 | 9 |
| 181 | 39 | 39 | 33 | 9 |
| 184 | 39 | 30 | 29 | 7 |
| 185 | 39 | 52 | 37 | 13 |
| 186 | 39 | 35 | 32 | 9 |
| 188 | 39 | 33 | 31 | 8 |
| 189 | 39 | 42 | 39 | 10 |
| 190 | 39 | 32 | 30 | 8 |
| 193 | 39 | 40 | 37 | 10 |
| 195 | 39 | 42 | 31 | 10 |
| 197 | 39 | 39 | 36 | 9 |
| 198 | 39 | 66 | 39 | 16 |
| 199 | 39 | 39 | 29 | 9 |
| 201 | 39 | 43 | 35 | 10 |
| 202 | 22 | 42 | 22 | 6 |
| 205 | 36 | 39 | 29 | 9 |
| 206 | 36 | 30 | 25 | 7 |
| 207 | 36 | 52 | 32 | 12 |
| 208 | 36 | 35 | 28 | 8 |
| 210 | 36 | 33 | 27 | 7 |
| 211 | 36 | 42 | 34 | 9 |
| 212 | 36 | 32 | 26 | 7 |
| 214 | 36 | 40 | 32 | 9 |
| 215 | 36 | 42 | 29 | 9 |
| 217 | 36 | 39 | 31 | 9 |
| 218 | 36 | 66 | 34 | 15 |
| 221 | 36 | 43 | 31 | 10 |
| 228 | 76 | 57 | 51 | 27 |
| 229 | 76 | 67 | 66 | 32 |
| 231 | | | | |
| 232 | 50 | 41 | 32 | 13 |
| 234 | 50 | 51 | 32 | 16 |
| 235 | 50 | 41 | 32 | 13 |
| 236 | | | | |
| 237 | | | | |
| 240 | 47 | 51 | 35 | 15 |
| 241 | 47 | 41 | 31 | 12 |
| 245 | 39 | 30 | 25 | 7 |
| 246 | 39 | 52 | 34 | 13 |
| 247 | 39 | 35 | 29 | 9 |
| 248 | 39 | 33 | 30 | 8 |
| 249 | 39 | 42 | 35 | 10 |
| 250 | 39 | 32 | 26 | 8 |
| 251 | 39 | 40 | 34 | 10 |
| 252 | 39 | 42 | 30 | 10 |
| 254 | 39 | 39 | 32 | 9 |
| 255 | 39 | 66 | 36 | 16 |
| 256 | 39 | 39 | 27 | 9 |
| 258 | 39 | 43 | 32 | 10 |

TABLE 16-continued

| | | | | |
|---|---|---|---|---|
| 259 | 29 | 51 | 29 | 9 |
| 260 | 27 | 33 | 26 | 6 |
| 261 | 27 | 42 | 27 | 7 |
| 262 | 27 | 40 | 27 | 7 |
| 267 | 57 | 67 | 48 | 24 |
| 269 | 35 | 52 | 29 | 11 |
| 270 | 35 | 42 | 28 | 9 |
| 271 | 35 | 40 | 27 | 9 |
| 272 | 35 | 39 | 25 | 9 |
| 273 | 41 | 51 | 33 | 13 |
| 274 | 41 | 41 | 31 | 10 |
| 280 | 43 | 39 | 27 | 10 |
| 283 | 51 | 74 | 41 | 23 |
| 286 | 30 | 52 | 29 | 10 |
| 287 | 30 | 35 | 23 | 7 |
| 289 | 30 | 33 | 27 | 6 |
| 290 | 30 | 42 | 30 | 8 |
| 291 | 30 | 32 | 25 | 6 |
| 293 | 30 | 40 | 30 | 8 |
| 294 | 30 | 42 | 25 | 8 |
| 296 | 30 | 39 | 27 | 7 |
| 297 | 30 | 66 | 30 | 12 |
| 300 | 30 | 43 | 28 | 8 |
| 301 | 52 | 35 | 32 | 11 |
| 303 | 52 | 33 | 33 | 11 |
| 304 | 52 | 42 | 39 | 14 |
| 305 | 52 | 32 | 30 | 10 |
| 307 | 52 | 40 | 37 | 13 |
| 308 | 52 | 42 | 32 | 14 |
| 310 | 52 | 39 | 36 | 13 |
| 311 | 52 | 66 | 41 | 21 |
| 312 | 52 | 39 | 29 | 13 |
| 314 | 52 | 43 | 36 | 14 |
| 315 | | | | |
| 317 | 22 | 42 | 22 | 6 |
| 318 | 22 | 39 | 22 | 5 |
| 319 | 35 | 33 | 27 | 7 |
| 320 | 35 | 42 | 35 | 9 |
| 321 | 35 | 32 | 27 | 7 |
| 322 | 35 | 40 | 33 | 9 |
| 323 | 35 | 42 | 26 | 9 |
| 324 | 35 | 39 | 35 | 9 |
| 325 | 35 | 66 | 35 | 14 |
| 328 | 35 | 43 | 32 | 9 |
| 329 | 33 | 42 | 26 | 9 |
| 335 | 33 | 43 | 25 | 9 |
| 337 | 51 | 41 | 30 | 13 |
| 338 | 33 | 42 | 33 | 9 |
| 339 | 33 | 32 | 26 | 7 |
| 341 | 33 | 40 | 33 | 8 |
| 342 | 33 | 42 | 27 | 9 |
| 344 | 33 | 39 | 30 | 8 |
| 345 | 33 | 66 | 33 | 14 |
| 348 | 33 | 43 | 31 | 9 |
| 349 | 42 | 32 | 32 | 8 |
| 352 | 42 | 40 | 40 | 10 |
| 354 | 42 | 42 | 33 | 11 |
| 357 | 42 | 39 | 39 | 10 |
| 359 | 42 | 66 | 42 | 17 |
| 360 | 42 | 39 | 30 | 10 |
| 362 | 42 | 43 | 38 | 11 |
| 364 | | | | |
| 366 | 32 | 40 | 31 | 8 |
| 367 | 32 | 42 | 26 | 8 |
| 369 | 32 | 39 | 31 | 8 |
| 370 | 32 | 66 | 32 | 13 |
| 371 | 32 | 39 | 24 | 8 |
| 373 | 32 | 43 | 29 | 9 |
| 379 | 40 | 42 | 31 | 10 |
| 381 | 40 | 39 | 37 | 10 |
| 383 | 40 | 66 | 40 | 16 |
| 384 | 40 | 39 | 28 | 10 |
| 386 | 40 | 43 | 37 | 11 |
| 389 | 42 | 39 | 30 | 10 |
| 390 | 42 | 66 | 35 | 17 |
| 392 | 42 | 43 | 29 | 11 |
| 398 | 35 | 66 | 31 | 14 |
| 400 | 39 | 66 | 39 | 16 |
| 401 | 39 | 39 | 28 | 9 |
| 403 | 39 | 43 | 35 | 10 |

TABLE 16-continued

| | | | | |
|---|---|---|---|---|
| 407 | 66 | 43 | 40 | 18 |
| 409 | 39 | 43 | 27 | 10 |
| 411 | | | | |
| 412 | | | | |
| 413 | | | | |
| 414 | | | | |
| 415 | | | | |
| 416 | | | | |
| 417 | | | | |
| 418 | | | | |
| 419 | | | | |
| 420 | | | | |
| 421 | | | | |
| 422 | | | | |
| 423 | | | | |
| 424 | | | | |
| 425 | | | | |
| 426 | | | | |
| 427 | | | | |
| 428 | | | | |
| 429 | | | | |
| 430 | | | | |
| 431 | | | | |
| 432 | | | | |
| 433 | | | | |
| 434 | | | | |
| 435 | | | | |
| 436 | | | | |
| 437 | | | | |
| 438 | | | | |
| 439 | | | | |
| 440 | | | | |
| 441 | | | | |
| 442 | | | | |
| 443 | | | | |
| 444 | | | | |
| 445 | | | | |
| 446 | | | | |
| 447 | | | | |
| 448 | | | | |
| 449 | | | | |
| 450 | | | | |
| 451 | | | | |
| 452 | | | | |
| 453 | | | | |
| 454 | | | | |
| 455 | | | | |
| 456 | | | | |
| 457 | | | | |
| 458 | | | | |
| 459 | | | | |
| 460 | | | | |
| 461 | | | | |
| 462 | | | | |
| 463 | | | | |
| 464 | | | | |
| 465 | | | | |
| 466 | | | | |
| 467 | | | | |
| 468 | | | | |
| 469 | | | | |
| 470 | | | | |
| 471 | | | | |
| 472 | | | | |
| 473 | | | | |
| 474 | | | | |
| 475 | | | | |
| 476 | | | | |
| 477 | | | | |
| 478 | | | | |
| 479 | | | | |
| 480 | | | | |
| 481 | | | | |
| 482 | | | | |
| 483 | | | | |
| 484 | | | | |
| 485 | | | | |
| 486 | | | | |
| 487 | | | | |
| 488 | | | | |

TABLE 16-continued

| | | | | |
|---|---|---|---|---|
| 489 | | | | |
| 490 | | | | |
| 491 | | | | |
| 492 | | | | |
| 493 | | | | |
| 494 | | | | |
| 495 | | | | |
| 496 | | | | |
| 497 | | | | |
| 498 | | | | |
| 499 | | | | |
| 500 | | | | |
| 501 | | | | |
| 502 | | | | |
| 503 | | | | |
| 504 | | | | |
| 505 | | | | |
| 506 | | | | |
| 507 | | | | |
| 508 | | | | |
| 509 | | | | |
| 510 | | | | |
| 511 | | | | |
| 512 | | | | |
| 513 | | | | |
| 514 | | | | |
| 515 | | | | |
| 516 | | | | |
| 517 | | | | |
| 518 | | | | |
| 524 | 21 | 35 | 21 | 5 |
| 539 | 42 | 24 | 24 | 6 |
| 542 | 42 | 24 | 24 | 6 |
| 548 | 42 | 67 | 41 | 18 |
| 558 | 37 | 24 | 22 | 6 |
| 560 | 37 | 24 | 22 | 6 |
| 565 | 37 | 67 | 36 | 15 |
| 572 | 24 | 39 | 23 | 6 |
| 575 | 24 | 35 | 23 | 5 |
| 576 | 24 | 42 | 24 | 6 |
| 579 | 24 | 39 | 24 | 6 |
| 589 | 42 | 57 | 35 | 15 |
| 594 | 42 | 67 | 41 | 18 |
| 603 | 42 | 35 | 28 | 9 |
| 622 | 64 | 67 | 46 | 27 |
| 655 | 24 | 39 | 24 | 6 |
| 659 | 24 | 42 | 24 | 6 |
| 660 | 24 | 40 | 23 | 6 |
| 661 | 24 | 39 | 22 | 6 |
| 672 | 57 | 34 | 29 | 12 |
| 674 | 57 | 66 | 42 | 23 |
| 683 | 39 | 67 | 38 | 16 |
| 719 | 36 | 67 | 34 | 15 |
| 738 | 76 | 51 | 41 | 24 |
| 740 | 39 | 27 | 25 | 7 |
| 746 | 27 | 52 | 27 | 9 |
| 747 | 27 | 35 | 24 | 6 |
| 748 | 27 | 39 | 25 | 7 |
| 764 | 67 | 52 | 40 | 22 |
| 766 | 67 | 35 | 35 | 15 |
| 767 | 67 | 42 | 41 | 18 |
| 768 | 67 | 32 | 31 | 13 |
| 769 | 67 | 40 | 39 | 17 |
| 770 | 67 | 42 | 35 | 18 |
| 771 | 67 | 39 | 38 | 16 |
| 772 | 67 | 66 | 48 | 28 |
| 773 | 67 | 43 | 38 | 18 |
| 778 | 35 | 30 | 23 | 7 |
| 782 | 35 | 43 | 26 | 9 |
| 830 | 33 | 42 | 25 | 9 |
| 933 | 42 | 51 | 30 | 13 |
| 1036 | 42 | 29 | 26 | 8 |
| 1070 | 29 | 41 | 26 | 7 |
| 1938 | 75 | 51 | 44 | 24 |
| 1943 | 75 | 74 | 55 | 35 |
| 2052 | 67 | 30 | 29 | 13 |
| 2290 | 64 | 35 | 31 | 14 |
| 2341 | 39 | 35 | 25 | 9 |
| 2402 | 35 | 33 | 24 | 7 |
| 2745 | 64 | 27 | 27 | 11 |

TABLE 16-continued

| | | | | | | | | | | | | |
|---|---|---|---|---|---|---|---|---|---|---|---|---|
| 3121 | | | | | 50 | 47 | 32 | 15 | | | | |
| 3123 | | | | | 50 | 57 | 35 | 18 | | | | |
| 3124 | | | | | 47 | 29 | 27 | 9 | | | | |
| 3125 | | | | | 47 | 41 | 31 | 12 | | | | |
| 3126 | | | | | 47 | 27 | 24 | 8 | | | | |
| 3127 | | | | | 29 | 41 | 27 | 7 | | | | |
| 3128 | | | | | 29 | 27 | 22 | 5 | | | | |
| 3129 | | | | | 41 | 27 | 23 | 7 | | | | |
| 3131 | | | | | 42 | 47 | 29 | 12 | | | | |
| 3132 | | | | | 36 | 39 | 27 | 9 | | | | |
| 3133 | | | | | 42 | 57 | 32 | 15 | | | | |
| 3134 | | | | | 42 | 27 | 25 | 7 | | | | |
| 3135 | | | | | 81 | 59 | 47 | 30 | | | | |
| 3136 | | | | | 37 | 67 | 34 | 15 | | | | |
| 3137 | | | | | 57 | 67 | 44 | 24 | | | | |
| 3138 | | | | | 57 | 42 | 32 | 15 | | | | |
| 3139 | | | | | 57 | 39 | 32 | 14 | | | | |
| 3140 | | | | | 39 | 27 | 25 | 7 | | | | |
| 3141 | | | | | 39 | 67 | 34 | 16 | | | | |
| 3142 | | | | | 27 | 43 | 25 | 7 | | | | |
| 3143 | | | | | 67 | 33 | 32 | 14 | | | | |
| 3144 | | | | | 36 | 39 | 25 | 9 | | | | |
| 3145 | | | | | 36 | 35 | 24 | 8 | | | | |
| 3146 | | | | | 24 | 39 | 22 | 6 | | | | |
| 3147 | | | | | 57 | 39 | 30 | 14 | | | | |
| 3148 | | | | | 57 | 35 | 29 | 12 | | | | |
| 3149 | | | | | 67 | 54 | 39 | 23 | | | | |
| 3150 | | | | | 67 | 35 | 31 | 15 | | | | |
| 3151 | | | | | 67 | 28 | 28 | 12 | | | | |
| 3152 | | | | | 67 | 51 | 38 | 21 | | | | |
| 3674 | 3 | 4 | 3 | 1 | | | | | | | | |
| 3675 | 3 | 4 | 3 | 1 | | | | | | | | |
| 3676 | 3 | 4 | 3 | 1 | | | | | | | | |
| 3678 | 4 | 4 | 4 | 1 | | | | | 36 | 20 | 19 | 7 |
| 3679 | 4 | 4 | 4 | 1 | | | | | 36 | 19 | 17 | 7 |
| 3680 | 4 | 3 | 3 | 1 | | | | | | | | |
| 3681 | | | | | | | | | 36 | 25 | 22 | 9 |
| 3682 | | | | | | | | | 36 | 31 | 26 | 11 |
| 3683 | | | | | | | | | 36 | 20 | 19 | 7 |
| 3684 | 4 | 3 | 3 | 1 | | | | | 36 | 37 | 30 | 13 |
| 3685 | 4 | 4 | 4 | 1 | | | | | | | | |
| 3686 | 4 | 3 | 3 | 1 | | | | | | | | |
| 3688 | 4 | 3 | 3 | 1 | | | | | | | | |
| 3690 | 4 | 3 | 3 | 1 | | | | | 19 | 37 | 18 | 7 |
| 3691 | | | | | | | | | 25 | 31 | 22 | 7 |
| 3693 | | | | | | | | | 25 | 37 | 23 | 9 |
| 3695 | | | | | | | | | 31 | 20 | 20 | 6 |
| 3696 | | | | | | | | | 31 | 37 | 25 | 11 |
| 3697 | 7 | 6 | 5 | 4 | | | | | 65 | 60 | 54 | 37 |
| 3698 | | | | | | | | | 49 | 54 | 39 | 25 |
| 3699 | | | | | | | | | 49 | 56 | 43 | 26 |
| 3700 | | | | | | | | | 37 | 26 | 26 | 9 |
| 3701 | | | | | | | | | 37 | 56 | 33 | 20 |
| 3702 | | | | | | | | | 20 | 37 | 18 | 7 |
| 3703 | 4 | 3 | 3 | 1 | | | | | | | | |
| 3704 | 4 | 3 | 3 | 1 | | | | | | | | |
| 3705 | 4 | 3 | 3 | 1 | | | | | | | | |
| 3706 | 4 | 4 | 3 | 1 | | | | | | | | |
| 3707 | 4 | 3 | 3 | 1 | | | | | | | | |
| 3708 | 4 | 3 | 3 | 1 | | | | | | | | |
| 3709 | 4 | 3 | 3 | 1 | | | | | | | | |
| 3710 | 4 | 3 | 3 | 1 | | | | | | | | |
| 3711 | 4 | 4 | 3 | 1 | | | | | | | | |
| 3712 | 4 | 3 | 3 | 1 | | | | | | | | |
| 3713 | 3 | 4 | 3 | 1 | | | | | | | | |
| 3714 | 3 | 4 | 3 | 1 | | | | | | | | |
| 3715 | 4 | 3 | 3 | 1 | | | | | | | | |
| 3716 | 4 | 3 | 3 | 1 | | | | | | | | |
| 3717 | 4 | 3 | 3 | 1 | | | | | | | | |
| 3718 | 4 | 4 | 3 | 1 | | | | | | | | |
| 3719 | 4 | 3 | 3 | 1 | | | | | | | | |
| 3720 | 3 | 4 | 3 | 1 | | | | | | | | |
| 3721 | 3 | 4 | 3 | 1 | | | | | | | | |
| 3722 | 4 | 6 | 4 | 2 | | | | | | | | |
| 3753 | | | | | | | | | 19 | 37 | 18 | 7 |
| 3757 | | | | | | | | | 37 | 21 | 18 | 7 |
| 3764 | | | | | | | | | 16 | 23 | 15 | 4 |
| 3769 | | | | | | | | | 22 | 25 | 16 | 5 |
| 3895 | | | | | | | | | 22 | 37 | 19 | 8 |
| 3896 | | | | | | | | | 29 | 37 | 23 | 10 |

TABLE 16-continued

| | | | | | |
|---|---|---|---|---|---|
| | 3897 | 29 | 45 | 27 | 12 |
| | 3898 | 29 | 26 | 22 | 7 |
| | 3901 | 18 | 37 | 17 | 6 |
| | 3902 | 49 | 37 | 30 | 17 |
| | 3903 | 54 | 56 | 40 | 29 |
| | 3904 | 26 | 56 | 25 | 14 |

TABLE 17

Phylogeny and OTU designation of the endophytes useful for use in the present invention.

| SEQ ID | OTU | Kingdom | Phylum | Class |
|---|---|---|---|---|
| 1 | B1.0|REF97__V4|147405 | Bacteria | Acidobacteria | Acidobacteria |
| 2 | B1.0|REF99__V4|22802 | Bacteria | Acidobacteria | Acidobacteria |
| 3 | B1.0|REF99__V4|4513 | Bacteria | Acidobacteria | Acidobacteria |
| 4 | B1.0|REF99__V4|72137 | Bacteria | Acidobacteria | Acidobacteria |
| 5 | B1.0|REF99__V4|14333 | Bacteria | Acidobacteria | Acidobacteria |
| 6 | B1.0|REF99__V4|8123 | Bacteria | Acidobacteria | Acidobacteria |
| 7 | B1.0|REF97__V4|14247 | Bacteria | Acidobacteria | Acidobacteria |
| 8 | B1.0|REF97__V4|8837 | Bacteria | Acidobacteria | Acidobacteria |
| 9 | B1.0|REF99__V4|6738 | Bacteria | Acidobacteria | Acidobacteria |
| 10 | B1.0|REF99__V4|214570 | Bacteria | Acidobacteria | Acidobacteria |
| 11 | B1.0|REF99__V4|1300 | Bacteria | Acidobacteria | Acidobacteria |
| 12 | B1.0|REF99__V4|19713 | Bacteria | Acidobacteria | Acidobacteria |
| 13 | B1.0|REF99__V4|160973 | Bacteria | Acidobacteria | Acidobacteria |
| 14 | B1.0|REF97__V4|8215 | Bacteria | Acidobacteria | Acidobacteria |
| 15 | B1.0|REF97__V4|55240 | Bacteria | Acidobacteria | Acidobacteria |
| 16 | B1.0|REF97__V4|147046 | Bacteria | Acidobacteria | Acidobacteria |
| 17 | B1.0|REF97__V4|25971 | Bacteria | Acidobacteria | Acidobacteria |
| 18 | B1.0|REF99__V4|21011 | Bacteria | Acidobacteria | Acidobacteria |
| 19 | B1.0|REF99__V4|55138 | Bacteria | Acidobacteria | Acidobacteria |
| 20 | B1.0|REF99__V4|3309, B1.0|REF97__V4|3309 | Bacteria | Acidobacteria | Acidobacteria |
| 21 | B1.0|REF99__V4|11730 | Bacteria | Acidobacteria | Acidobacteria |
| 22 | B1.0|REF99__V4|1263 | Bacteria | Acidobacteria | Acidobacteria |
| 23 | B1.0|REF99__V4|9741 | Bacteria | Acidobacteria | Acidobacteria |
| 24 | B1.0|REF99__V4|20204 | Bacteria | Acidobacteria | Acidobacteria |
| 25 | B1.0|REF99__V4|15636 | Bacteria | Acidobacteria | Acidobacteria |
| 26 | B1.0|REF99__V4|10433 | Bacteria | Acidobacteria | Acidobacteria |
| 27 | B1.0|REF99__V4|233747 | Bacteria | Acidobacteria | Acidobacteria |
| 28 | B1.0|REF99__V4|11416 | Bacteria | Acidobacteria | Acidobacteria |
| 29 | B1.0|REF97__V4|34470 | Bacteria | Acidobacteria | Acidobacteria |
| 30 | B1.0|REF97__V4|82145 | Bacteria | Acidobacteria | Acidobacteria |
| 31 | B1.0|REF99__V4|68850 | Bacteria | Acidobacteria | Acidobacteria |
| 32 | B1.0|REF99__V4|74336 | Bacteria | Acidobacteria | Acidobacteria |
| 33 | B1.0|REF99__V4|202714 | Bacteria | Acidobacteria | Acidobacteria |
| 34 | B1.0|REF99__V4|1421 | Bacteria | Acidobacteria | Acidobacteria |
| 35 | B1.0|REF99__V4|4755 | Bacteria | Acidobacteria | Acidobacteria |
| 36 | B1.0|REF99__V4|79545 | Bacteria | Acidobacteria | Acidobacteria |
| 37 | B1.0|REF99__V4|5450 | Bacteria | Acidobacteria | Acidobacteria |
| 38 | B1.0|REF99__V4|8289 | Bacteria | Acidobacteria | Acidobacteria |
| 39 | B1.0|REF99__V4|13960 | Bacteria | Acidobacteria | Acidobacteria |
| 40 | B1.0|REF97__V4|126275 | Bacteria | Acidobacteria | Acidobacteria |
| 41 | B1.0|REF99__V4|14512, B1.0|REF97__V4|14512 | Bacteria | Acidobacteria | Acidobacteria |
| 42 | B1.0|REF99__V4|64256 | Bacteria | Acidobacteria | Acidobacteria-6 |
| 43 | B1.0|REF99__V4|2265 | Bacteria | Acidobacteria | Acidobacteriia |
| 44 | B1.0|REF99__V4|75760 | Bacteria | Acidobacteria | Acidobacteriia |
| 45 | B1.0|REF99__V4|98943 | Bacteria | Acidobacteria | Acidobacteriia |
| 46 | B1.0|REF99__V4|57767 | Bacteria | Acidobacteria | Holophagae |
| 47 | B1.0|REF99__V4|82844 | Bacteria | Acidobacteria | Holophagae |
| 48 | B1.0|REF97__V4|25578 | Bacteria | Acidobacteria | Solibacteres |
| 49 | B1.0|REF99__V4|18648 | Bacteria | Actinobacteria | Acidimicrobiia |
| 50 | B1.0|REF99__V4|54133 | Bacteria | Actinobacteria | Acidimicrobiia |
| 51 | B1.0|REF99__V4|146432 | Bacteria | Actinobacteria | Acidimicrobiia |
| 52 | B1.0|REF99__V4|123327 | Bacteria | Actinobacteria | Acidimicrobiia |
| 53 | B1.0|REF99__V4|235179 | Bacteria | Actinobacteria | Acidimicrobiia |
| 54 | B1.0|REF99__V4|118524 | Bacteria | Actinobacteria | Actinobacteria |
| 55 | B1.0|REF97__V4|27724 | Bacteria | Actinobacteria | Actinobacteria |
| 56 | B1.0|REF99__V4|23821 | Bacteria | Actinobacteria | Actinobacteria |
| 57 | B1.0|REF99__V4|2451 | Bacteria | Actinobacteria | Actinobacteria |
| 58 | B1.0|REF97__V4|144065 | Bacteria | Actinobacteria | Actinobacteria |
| 59 | B1.0|REF99__V4|171149 | Bacteria | Actinobacteria | Actinobacteria |
| 60 | B1.0|REF99__V4|514 | Bacteria | Actinobacteria | Actinobacteria |
| 61 | B1.0|REF99__V4|384 | Bacteria | Actinobacteria | Actinobacteria |
| 62 | B1.0|REF99__V4|1411 | Bacteria | Actinobacteria | Actinobacteria |

TABLE 17-continued

Phylogeny and OTU designation of the endophytes useful for use in the present invention.

| | | | | |
|---|---|---|---|---|
| 63 | B1.0|REF99__V4|22849 | Bacteria | Actinobacteria | Actinobacteria |
| 64 | B1.0|REF99__V4|734 | Bacteria | Actinobacteria | Actinobacteria |
| 65 | B1.0|REF99__V4|1441 | Bacteria | Actinobacteria | Actinobacteria |
| 66 | B1.0|REF99__V4|13732 | Bacteria | Actinobacteria | Actinobacteria |
| 67 | B1.0|REF99__V4|174851 | Bacteria | Actinobacteria | Actinobacteria |
| 68 | B1.0|REF99__V4|9521 | Bacteria | Actinobacteria | Actinobacteria |
| 69 | B1.0|REF99__V4|506 | Bacteria | Actinobacteria | Actinobacteria |
| 70 | B1.0|REF99__V4|266 | Bacteria | Actinobacteria | Actinobacteria |
| 71 | B1.0|REF99__V4|1351 | Bacteria | Actinobacteria | Actinobacteria |
| 72 | B1.0|REF99__V4|4123 | Bacteria | Actinobacteria | Actinobacteria |
| 73 | B1.0|REF99__V4|4363 | Bacteria | Actinobacteria | Actinobacteria |
| 74 | B1.0|REF99__V4|1470 | Bacteria | Actinobacteria | Actinobacteria |
| 75 | B1.0|REF99__V4|721 | Bacteria | Actinobacteria | Actinobacteria |
| 76 | B1.0|REF99__V4|23168 | Bacteria | Actinobacteria | Actinobacteria |
| 77 | B1.0|REF99__V4|304 | Bacteria | Actinobacteria | Actinobacteria |
| 78 | B1.0|REF99__V4|613 | Bacteria | Actinobacteria | Actinobacteria |
| 79 | B1.0|REF99__V4|9963 | Bacteria | Actinobacteria | Actinobacteria |
| 80 | B1.0|REF99__V4|2297 | Bacteria | Actinobacteria | Actinobacteria |
| 81 | B1.0|REF99__V4|35773 | Bacteria | Actinobacteria | Actinobacteria |
| 82 | B1.0|REF99__V4|7060 | Bacteria | Actinobacteria | Actinobacteria |
| 83 | B1.0|REF99__V4|157695 | Bacteria | Actinobacteria | Actinobacteria |
| 84 | B1.0|REF99__V4|13862 | Bacteria | Actinobacteria | Actinobacteria |
| 85 | B1.0|REF99__V4|205434 | Bacteria | Actinobacteria | Actinobacteria |
| 86 | B1.0|REF97__V4|108700 | Bacteria | Actinobacteria | Actinobacteria |
| 87 | B1.0|REF99__V4|9907 | Bacteria | Actinobacteria | Actinobacteria |
| 88 | B1.0|REF97__V4|7259 | Bacteria | Actinobacteria | Actinobacteria |
| 89 | B1.0|REF99__V4|9456 | Bacteria | Actinobacteria | Actinobacteria |
| 90 | B1.0|REF99__V4|146293, B1.0|REF97__V4|146293 | Bacteria | Actinobacteria | Actinobacteria |
| 91 | B1.0|REF99__V4|26186 | Bacteria | Actinobacteria | Actinobacteria |
| 92 | B1.0|REF99__V4|4026 | Bacteria | Actinobacteria | Actinobacteria |
| 93 | B1.0|REF99__V4|244930 | Bacteria | Actinobacteria | Actinobacteria |
| 94 | B1.0|REF99__V4|162631 | Bacteria | Actinobacteria | Actinobacteria |
| 95 | B1.0|REF99__V4|72556 | Bacteria | Actinobacteria | Actinobacteria |
| 96 | B1.0|REF99__V4|6297 | Bacteria | Actinobacteria | Actinobacteria |
| 97 | B1.0|REF99__V4|1601 | Bacteria | Actinobacteria | Actinobacteria |
| 98 | B1.0|REF99__V4|6153 | Bacteria | Actinobacteria | Actinobacteria |
| 99 | B1.0|REF99__V4|894 | Bacteria | Actinobacteria | Actinobacteria |
| 100 | B1.0|REF99__V4|4195 | Bacteria | Actinobacteria | Actinobacteria |
| 101 | B1.0|REF99__V4|197082 | Bacteria | Actinobacteria | Actinobacteria |
| 102 | B1.0|REF99__V4|201778 | Bacteria | Actinobacteria | Actinobacteria |
| 103 | B1.0|REF99__V4|18161 | Bacteria | Actinobacteria | Actinobacteria |
| 104 | B1.0|REF99__V4|10124 | Bacteria | Actinobacteria | Actinobacteria |
| 105 | B1.0|REF99__V4|2738 | Bacteria | Actinobacteria | Actinobacteria |
| 106 | B1.0|REF99__V4|25535 | Bacteria | Actinobacteria | Actinobacteria |
| 107 | B1.0|REF99__V4|106470 | Bacteria | Actinobacteria | Actinobacteria |
| 108 | B1.0|REF99__V4|219948, B1.0|REF97__V4|219948 | Bacteria | Actinobacteria | Actinobacteria |
| 109 | B1.0|REF99__V4|7734, B1.0|REF97__V4|7734 | Bacteria | Actinobacteria | Actinobacteria |
| 110 | B1.0|REF99__V4|24254 | Bacteria | Actinobacteria | Actinobacteria |
| 111 | B1.0|REF99__V4|1256 | Bacteria | Actinobacteria | Actinobacteria |
| 112 | B1.0|REF99__V4|3791 | Bacteria | Actinobacteria | Actinobacteria |
| 113 | B1.0|REF99__V4|14355 | Bacteria | Actinobacteria | Actinobacteria |
| 114 | B1.0|REF99__V4|7885 | Bacteria | Actinobacteria | Actinobacteria |
| 115 | B1.0|REF99__V4|93783, B1.0|REF97__V4|93783 | Bacteria | Actinobacteria | Actinobacteria |
| 116 | B1.0|REF99__V4|1567 | Bacteria | Actinobacteria | Actinobacteria |
| 117 | B1.0|REF99__V4|6561 | Bacteria | Actinobacteria | Actinobacteria |
| 118 | B1.0|REF99__V4|2750 | Bacteria | Actinobacteria | Actinobacteria |
| 119 | B1.0|REF99__V4|3236 | Bacteria | Actinobacteria | Actinobacteria |
| 120 | B1.0|REF99__V4|54859 | Bacteria | Actinobacteria | Actinobacteria |
| 121 | B1.0|REF99__V4|1211 | Bacteria | Actinobacteria | Actinobacteria |
| 122 | B1.0|REF99__V4|3568 | Bacteria | Actinobacteria | Actinobacteria |
| 123 | B1.0|REF99__V4|19580 | Bacteria | Actinobacteria | Actinobacteria |
| 124 | B1.0|REF99__V4|120402 | Bacteria | Actinobacteria | Actinobacteria |
| 125 | B1.0|REF99__V4|566, B1.0|REF97__V4|566 | Bacteria | Actinobacteria | Actinobacteria |
| 126 | B1.0|REF97__V4|89197 | Bacteria | Actinobacteria | Actinobacteria |
| 127 | B1.0|REF99__V4|2494 | Bacteria | Actinobacteria | Actinobacteria |
| 128 | B1.0|REF99__V4|643 | Bacteria | Actinobacteria | Actinobacteria |
| 129 | B1.0|REF99__V4|1758 | Bacteria | Actinobacteria | Actinobacteria |
| 130 | B1.0|REF99__V4|763 | Bacteria | Actinobacteria | Actinobacteria |
| 131 | B1.0|REF99__V4|251, B1.0|REF97__V4|251 | Bacteria | Actinobacteria | Actinobacteria |
| 132 | B1.0|REF99__V4|74474 | Bacteria | Actinobacteria | Actinobacteria |
| 133 | B1.0|REF99__V4|15242 | Bacteria | Actinobacteria | Actinobacteria |
| 134 | B1.0|REF99__V4|176667 | Bacteria | Actinobacteria | Actinobacteria |

TABLE 17-continued

Phylogeny and OTU designation of the endophytes useful for use in the present invention.

| | | | | |
|---|---|---|---|---|
| 135 | B1.0|REF99__V4|12074 | Bacteria | Actinobacteria | Actinobacteria |
| 136 | B1.0|REF99__V4|521 | Bacteria | Actinobacteria | Actinobacteria |
| 137 | B1.0|REF99__V4|11, B1.0|REF97__V4|11 | Bacteria | Actinobacteria | Actinobacteria |
| 138 | B1.0|REF99__V4|1543, B1.0|REF97__V4|1543 | Bacteria | Actinobacteria | Actinobacteria |
| 139 | B1.0|REF99__V4|1577 | Bacteria | Actinobacteria | Actinobacteria |
| 140 | B1.0|REF99__V4|199511 | Bacteria | Actinobacteria | Actinobacteria |
| 141 | B1.0|REF99__V4|4714 | Bacteria | Actinobacteria | Actinobacteria |
| 142 | B1.0|REF99__V4|3977 | Bacteria | Actinobacteria | Actinobacteria |
| 143 | B1.0|REF99__V4|13437 | Bacteria | Actinobacteria | Actinobacteria |
| 144 | B1.0|REF99__V4|5092 | Bacteria | Actinobacteria | Actinobacteria |
| 145 | B1.0|REF99__V4|4626 | Bacteria | Actinobacteria | Actinobacteria |
| 146 | B1.0|REF99__V4|5205 | Bacteria | Actinobacteria | Actinobacteria |
| 147 | B1.0|REF99__V4|231222 | Bacteria | Actinobacteria | Actinobacteria |
| 148 | B1.0|REF99__V4|3742, B1.0|REF97__V4|3742 | Bacteria | Actinobacteria | Actinobacteria |
| 149 | B1.0|REF97__V4|11530 | Bacteria | Actinobacteria | Actinobacteria |
| 150 | B1.0|REF97__V4|7889 | Bacteria | Actinobacteria | Actinobacteria |
| 151 | B1.0|REF99__V4|1864 | Bacteria | Actinobacteria | Actinobacteria |
| 152 | B1.0|REF99__V4|2218 | Bacteria | Actinobacteria | Actinobacteria |
| 153 | B1.0|REF99__V4|217666 | Bacteria | Actinobacteria | Actinobacteria |
| 154 | B1.0|REF99__V4|6974 | Bacteria | Actinobacteria | Actinobacteria |
| 155 | B1.0|REF99__V4|5063 | Bacteria | Actinobacteria | Actinobacteria |
| 156 | B1.0|REF99__V4|68371 | Bacteria | Actinobacteria | Actinobacteria |
| 157 | B1.0|REF99__V4|235005 | Bacteria | Actinobacteria | Actinobacteria |
| 158 | B1.0|REF99__V4|11615 | Bacteria | Actinobacteria | Actinobacteria |
| 159 | B1.0|REF99__V4|3179 | Bacteria | Actinobacteria | Actinobacteria |
| 160 | B1.0|REF99__V4|2484 | Bacteria | Actinobacteria | Actinobacteria |
| 161 | B1.0|REF99__V4|35089 | Bacteria | Actinobacteria | Actinobacteria |
| 162 | B1.0|REF97__V4|5769 | Bacteria | Actinobacteria | Actinobacteria |
| 163 | B1.0|REF99__V4|11402 | Bacteria | Actinobacteria | Actinobacteria |
| 164 | B1.0|REF99__V4|10664 | Bacteria | Actinobacteria | Actinobacteria |
| 165 | B1.0|REF99__V4|6839 | Bacteria | Actinobacteria | Actinobacteria |
| 166 | B1.0|REF99__V4|210501 | Bacteria | Actinobacteria | Actinobacteria |
| 167 | B1.0|REF97__V4|7967 | Bacteria | Actinobacteria | Actinobacteria |
| 168 | B1.0|REF99__V4|67260 | Bacteria | Actinobacteria | Actinobacteria |
| 169 | B1.0|REF99__V4|5839 | Bacteria | Actinobacteria | Actinobacteria |
| 170 | B1.0|REF99__V4|2369 | Bacteria | Actinobacteria | Actinobacteria |
| 171 | B1.0|REF99__V4|9881 | Bacteria | Actinobacteria | Actinobacteria |
| 172 | B1.0|SYM97__V4|246 | Bacteria | Actinobacteria | Actinobacteria |
| 173 | B1.0|REF99__V4|33240, B1.0|REF97__V4|33240 | Bacteria | Actinobacteria | Actinobacteria |
| 174 | B1.0|REF99__V4|1694 | Bacteria | Actinobacteria | Actinobacteria |
| 175 | B1.0|REF99__V4|1068 | Bacteria | Actinobacteria | Actinobacteria |
| 176 | B1.0|REF99__V4|5206, B1.0|REF97__V4|5206 | Bacteria | Actinobacteria | Actinobacteria |
| 177 | B1.0|REF99__V4|1883 | Bacteria | Actinobacteria | Actinobacteria |
| 178 | B1.0|REF99__V4|211 | Bacteria | Actinobacteria | Actinobacteria |
| 179 | B1.0|REF97__V4|15046 | Bacteria | Actinobacteria | Actinobacteria |
| 180 | B1.0|REF99__V4|12028 | Bacteria | Actinobacteria | Actinobacteria |
| 181 | B1.0|REF99__V4|473, B1.0|REF97__V4|473 | Bacteria | Actinobacteria | Actinobacteria |
| 182 | B1.0|REF99__V4|333 | Bacteria | Actinobacteria | Actinobacteria |
| 183 | B1.0|REF99__V4|1915 | Bacteria | Actinobacteria | Actinobacteria |
| 184 | B1.0|REF99__V4|57 | Bacteria | Actinobacteria | Actinobacteria |
| 185 | B1.0|REF99__V4|1912 | Bacteria | Actinobacteria | Actinobacteria |
| 186 | B1.0|REF99__V4|190429 | Bacteria | Actinobacteria | Actinobacteria |
| 187 | B1.0|REF99__V4|84, B1.0|REF97__V4|84 | Bacteria | Actinobacteria | Actinobacteria |
| 188 | B1.0|REF99__V4|483, B1.0|REF97__V4|483 | Bacteria | Actinobacteria | Actinobacteria |
| 189 | B1.0|REF99__V4|755, B1.0|REF97__V4|755 | Bacteria | Actinobacteria | Actinobacteria |
| 190 | B1.0|REF99__V4|10565, B1.0|REF97__V4|10565 | Bacteria | Actinobacteria | Actinobacteria |
| 191 | B1.0|REF99__V4|74069 | Bacteria | Actinobacteria | Actinobacteria |
| 192 | B1.0|REF99__V4|1060 | Bacteria | Actinobacteria | Actinobacteria |
| 193 | B1.0|REF99__V4|12144 | Bacteria | Actinobacteria | Actinobacteria |
| 194 | B1.0|REF99__V4|82 | Bacteria | Actinobacteria | Actinobacteria |
| 195 | B1.0|REF99__V4|11980 | Bacteria | Actinobacteria | Actinobacteria |
| 196 | B1.0|REF99__V4|20872 | Bacteria | Actinobacteria | Rubrobacteria |
| 197 | B1.0|REF99__V4|12235 | Bacteria | Actinobacteria | Rubrobacteria |
| 198 | B1.0|REF99__V4|26342 | Bacteria | Actinobacteria | Rubrobacteria |
| 199 | B1.0|REF99__V4|20736 | Bacteria | Actinobacteria | Rubrobacteria |
| 200 | B1.0|REF99__V4|92836 | Bacteria | Actinobacteria | Thermoleophilia |
| 201 | B1.0|REF99__V4|25299, B1.0|REF97__V4|25299 | Bacteria | Actinobacteria | Thermoleophilia |

TABLE 17-continued

Phylogeny and OTU designation of the endophytes useful for use in the present invention.

| | | | | |
|---|---|---|---|---|
| 202 | B1.0|REF99__V4|126949 | Bacteria | Actinobacteria | Thermoleophilia |
| 203 | B1.0|REF97__V4|91884 | Bacteria | Actinobacteria | Thermoleophilia |
| 204 | B1.0|REF97__V4|126078 | Bacteria | Actinobacteria | Thermoleophilia |
| 205 | B1.0|REF99__V4|92877, B1.0|REF97__V4|92877 | Bacteria | Actinobacteria | Thermoleophilia |
| 206 | B1.0|REF99__V4|20021 | Bacteria | Actinobacteria | Thermoleophilia |
| 207 | B1.0|REF99__V4|15842 | Bacteria | Actinobacteria | Thermoleophilia |
| 208 | B1.0|REF99__V4|58705 | Bacteria | Actinobacteria | Thermoleophilia |
| 209 | B1.0|REF99__V4|146282, B1.0|REF97__V4|146282 | Bacteria | Actinobacteria | Thermoleophilia |
| 210 | B1.0|REF99__V4|9977 | Bacteria | Actinobacteria | Thermoleophilia |
| 211 | B1.0|REF97__V4|233384 | Bacteria | Armatimonadetes | Chthonomonadetes |
| 212 | B1.0|REF97__V4|112186 | Bacteria | Armatimonadetes | |
| 213 | B1.0|REF97__V4|117649 | Bacteria | Armatimonadetes | |
| 214 | B1.0|REF99__V4|4025 | Bacteria | Bacteroidetes | Bacteroidia |
| 215 | B1.0|REF99__V4|5370 | Bacteria | Bacteroidetes | Bacteroidia |
| 216 | B1.0|REF99__V4|7485 | Bacteria | Bacteroidetes | Bacteroidia |
| 217 | B1.0|REF99__V4|886 | Bacteria | Bacteroidetes | Bacteroidia |
| 218 | B1.0|REF99__V4|1904 | Bacteria | Bacteroidetes | Bacteroidia |
| 219 | B1.0|REF99__V4|7409 | Bacteria | Bacteroidetes | Bacteroidia |
| 220 | B1.0|REF97__V4|37144 | Bacteria | Bacteroidetes | BME43 |
| 221 | B1.0|REF99__V4|50172, B1.0|REF97__V4|50172 | Bacteria | Bacteroidetes | Cytophagia |
| 222 | B1.0|REF97__V4|122473 | Bacteria | Bacteroidetes | Cytophagia |
| 223 | B1.0|REF97__V4|22377 | Bacteria | Bacteroidetes | Cytophagia |
| 224 | B1.0|REF97__V4|124658 | Bacteria | Bacteroidetes | Cytophagia |
| 225 | B1.0|REF99__V4|111445 | Bacteria | Bacteroidetes | Cytophagia |
| 226 | B1.0|REF99__V4|163974, B1.0|REF97__V4|163974 | Bacteria | Bacteroidetes | Cytophagia |
| 227 | B1.0|REF97__V4|32097 | Bacteria | Bacteroidetes | Cytophagia |
| 228 | B1.0|REF97__V4|11207 | Bacteria | Bacteroidetes | Cytophagia |
| 229 | B1.0|REF99__V4|158282, B1.0|REF97__V4|158282 | Bacteria | Bacteroidetes | Cytophagia |
| 230 | B1.0|REF97__V4|131939 | Bacteria | Bacteroidetes | Cytophagia |
| 231 | B1.0|REF99__V4|97104 | Bacteria | Bacteroidetes | Cytophagia |
| 232 | B1.0|REF97__V4|134741 | Bacteria | Bacteroidetes | Cytophagia |
| 233 | B1.0|REF97__V4|234977 | Bacteria | Bacteroidetes | Cytophagia |
| 234 | B1.0|REF99__V4|12784, B1.0|REF97__V4|12784 | Bacteria | Bacteroidetes | Cytophagia |
| 235 | B1.0|REF99__V4|202709 | Bacteria | Bacteroidetes | Cytophagia |
| 236 | B1.0|SYM97__V4|38 | Bacteria | Bacteroidetes | Cytophagia |
| 237 | B1.0|REF97__V4|164140 | Bacteria | Bacteroidetes | Cytophagia |
| 238 | B1.0|REF99__V4|30765 | Bacteria | Bacteroidetes | Cytophagia |
| 239 | B1.0|REF99__V4|12199, B1.0|REF97__V4|12199 | Bacteria | Bacteroidetes | Cytophagia |
| 240 | B1.0|REF99__V4|105532 | Bacteria | Bacteroidetes | Cytophagia |
| 241 | B1.0|REF99__V4|131348, B1.0|REF97__V4|131348 | Bacteria | Bacteroidetes | Cytophagia |
| 242 | B1.0|REF99__V4|25893 | Bacteria | Bacteroidetes | Cytophagia |
| 243 | B1.0|REF99__V4|214558 | Bacteria | Bacteroidetes | Cytophagia |
| 244 | B1.0|REF99__V4|18173 | Bacteria | Bacteroidetes | Cytophagia |
| 245 | B1.0|REF99__V4|228480 | Bacteria | Bacteroidetes | Cytophagia |
| 246 | B1.0|REF97__V4|240146 | Bacteria | Bacteroidetes | Cytophagia |
| 247 | B1.0|REF99__V4|107329 | Bacteria | Bacteroidetes | Cytophagia |
| 248 | B1.0|REF99__V4|11084 | Bacteria | Bacteroidetes | Cytophagia |
| 249 | B1.0|REF99__V4|24558 | Bacteria | Bacteroidetes | Cytophagia |
| 250 | B1.0|REF99__V4|7125 | Bacteria | Bacteroidetes | Cytophagia |
| 251 | B1.0|REF99__V4|25933 | Bacteria | Bacteroidetes | Cytophagia |
| 252 | B1.0|REF97__V4|88289 | Bacteria | Bacteroidetes | Cytophagia |
| 253 | B1.0|REF97__V4|240774 | Bacteria | Bacteroidetes | Cytophagia |
| 254 | B1.0|REF99__V4|15678 | Bacteria | Bacteroidetes | Cytophagia |
| 255 | B1.0|REF99__V4|75079 | Bacteria | Bacteroidetes | Cytophagia |
| 256 | B1.0|REF97__V4|145252 | Bacteria | Bacteroidetes | Cytophagia |
| 257 | B1.0|REF99__V4|6735 | Bacteria | Bacteroidetes | Cytophagia |
| 258 | B1.0|REF97__V4|75615 | Bacteria | Bacteroidetes | Cytophagia |
| 259 | B1.0|REF99__V4|166126 | Bacteria | Bacteroidetes | Cytophagia |
| 260 | B1.0|REF99__V4|14662, B1.0|REF97__V4|14662 | Bacteria | Bacteroidetes | Cytophagia |
| 261 | B1.0|REF97__V4|74624 | Bacteria | Bacteroidetes | Cytophagia |
| 262 | B1.0|REF99__V4|74296 | Bacteria | Bacteroidetes | Cytophagia |
| 263 | B1.0|REF97__V4|22681 | Bacteria | Bacteroidetes | Cytophagia |
| 264 | B1.0|REF99__V4|18433 | Bacteria | Bacteroidetes | Cytophagia |
| 265 | B1.0|REF99__V4|190866 | Bacteria | Bacteroidetes | Cytophagia |
| 266 | B1.0|REF97__V4|112845 | Bacteria | Bacteroidetes | Cytophagia |
| 267 | B1.0|REF97__V4|189174 | Bacteria | Bacteroidetes | Cytophagia |
| 268 | B1.0|REF97__V4|8688 | Bacteria | Bacteroidetes | Cytophagia |
| 269 | B1.0|REF97__V4|169389 | Bacteria | Bacteroidetes | Cytophagia |

TABLE 17-continued

Phylogeny and OTU designation of the endophytes useful for use in the present invention.

| | | | | |
|---|---|---|---|---|
| 270 | B1.0|REF99__V4|181479, B1.0|REF97__V4|181479 | Bacteria | Bacteroidetes | Cytophagia |
| 271 | B1.0|REF99__V4|17864 | Bacteria | Bacteroidetes | Cytophagia |
| 272 | B1.0|REF99__V4|59032 | Bacteria | Bacteroidetes | Cytophagia |
| 273 | B1.0|REF99__V4|10455, B1.0|REF97__V4|10455 | Bacteria | Bacteroidetes | Cytophagia |
| 274 | B1.0|REF97__V4|111161 | Bacteria | Bacteroidetes | Cytophagia |
| 275 | B1.0|REF97__V4|160669 | Bacteria | Bacteroidetes | Cytophagia |
| 276 | B1.0|REF97__V4|82318 | Bacteria | Bacteroidetes | Cytophagia |
| 277 | B1.0|REF99__V4|73426 | Bacteria | Bacteroidetes | Cytophagia |
| 278 | B1.0|REF99__V4|215593, B1.0|REF97__V4|215593 | Bacteria | Bacteroidetes | Flavobacteriia |
| 279 | B1.0|REF99__V4|205623 | Bacteria | Bacteroidetes | Flavobacteriia |
| 280 | B1.0|REF99__V4|118168 | Bacteria | Bacteroidetes | Flavobacteriia |
| 281 | B1.0|REF99__V4|117903 | Bacteria | Bacteroidetes | Flavobacteriia |
| 282 | B1.0|REF99__V4|15167, B1.0|REF97__V4|15167 | Bacteria | Bacteroidetes | Flavobacteriia |
| 283 | B1.0|REF99__V4|111881 | Bacteria | Bacteroidetes | Flavobacteriia |
| 284 | B1.0|REF99__V4|6993 | Bacteria | Bacteroidetes | Flavobacteriia |
| 285 | B1.0|REF99__V4|78274 | Bacteria | Bacteroidetes | Flavobacteriia |
| 286 | B1.0|REF99__V4|3295, B1.0|REF97__V4|3295 | Bacteria | Bacteroidetes | Flavobacteriia |
| 287 | B1.0|REF99__V4|162429, B1.0|REF97__V4|162429 | Bacteria | Bacteroidetes | Flavobacteriia |
| 288 | B1.0|REF99__V4|2133 | Bacteria | Bacteroidetes | Flavobacteriia |
| 289 | B1.0|REF99__V4|223406 | Bacteria | Bacteroidetes | Flavobacteriia |
| 290 | B1.0|REF99__V4|82179 | Bacteria | Bacteroidetes | Flavobacteriia |
| 291 | B1.0|REF99__V4|156910 | Bacteria | Bacteroidetes | Flavobacteriia |
| 292 | B1.0|REF99__V4|450 | Bacteria | Bacteroidetes | Flavobacteriia |
| 293 | B1.0|REF99__V4|10082 | Bacteria | Bacteroidetes | Flavobacteriia |
| 294 | B1.0|REF99__V4|10586 | Bacteria | Bacteroidetes | Flavobacteriia |
| 295 | B1.0|REF99__V4|508 | Bacteria | Bacteroidetes | Flavobacteriia |
| 296 | B1.0|REF99__V4|885 | Bacteria | Bacteroidetes | Flavobacteriia |
| 297 | B1.0|REF99__V4|1869, B1.0|REF97__V4|1869 | Bacteria | Bacteroidetes | Flavobacteriia |
| 298 | B1.0|REF99__V4|219957 | Bacteria | Bacteroidetes | Flavobacteriia |
| 299 | B1.0|REF99__V4|3425 | Bacteria | Bacteroidetes | Flavobacteriia |
| 300 | B1.0|REF99__V4|228763 | Bacteria | Bacteroidetes | Flavobacteriia |
| 301 | B1.0|REF99__V4|5358 | Bacteria | Bacteroidetes | Flavobacteriia |
| 302 | B1.0|REF99__V4|119953 | Bacteria | Bacteroidetes | Flavobacteriia |
| 303 | B1.0|REF99__V4|1741 | Bacteria | Bacteroidetes | Flavobacteriia |
| 304 | B1.0|REF99__V4|864, B1.0|REF97__V4|864 | Bacteria | Bacteroidetes | Flavobacteriia |
| 305 | B1.0|REF99__V4|5447 | Bacteria | Bacteroidetes | Flavobacteriia |
| 306 | B1.0|REF99__V4|54399 | Bacteria | Bacteroidetes | Flavobacteriia |
| 307 | B1.0|REF99__V4|156909 | Bacteria | Bacteroidetes | Flavobacteriia |
| 308 | B1.0|REF99__V4|2754 | Bacteria | Bacteroidetes | Flavobacteriia |
| 309 | B1.0|REF99__V4|12196 | Bacteria | Bacteroidetes | Flavobacteriia |
| 310 | B1.0|REF99__V4|1595 | Bacteria | Bacteroidetes | Flavobacteriia |
| 311 | B1.0|REF99__V4|179146 | Bacteria | Bacteroidetes | Saprospirae |
| 312 | B1.0|REF97__V4|51606 | Bacteria | Bacteroidetes | Saprospirae |
| 313 | B1.0|REF99__V4|18024, B1.0|REF97__V4|18024 | Bacteria | Bacteroidetes | Saprospirae |
| 314 | B1.0|REF97__V4|226541 | Bacteria | Bacteroidetes | Saprospirae |
| 315 | B1.0|REF99__V4|6354 | Bacteria | Bacteroidetes | Saprospirae |
| 316 | B1.0|REF99__V4|25282 | Bacteria | Bacteroidetes | Saprospirae |
| 317 | B1.0|REF99__V4|192404 | Bacteria | Bacteroidetes | Saprospirae |
| 318 | B1.0|REF99__V4|70988 | Bacteria | Bacteroidetes | Saprospirae |
| 319 | B1.0|REF99__V4|70731 | Bacteria | Bacteroidetes | Saprospirae |
| 320 | B1.0|REF99__V4|223167 | Bacteria | Bacteroidetes | Saprospirae |
| 321 | B1.0|REF97__V4|193764 | Bacteria | Bacteroidetes | Saprospirae |
| 322 | B1.0|REF99__V4|167379 | Bacteria | Bacteroidetes | Saprospirae |
| 323 | B1.0|REF99__V4|243239 | Bacteria | Bacteroidetes | Sphingobacteriia |
| 324 | B1.0|REF99__V4|72481 | Bacteria | Bacteroidetes | Sphingobacteriia |
| 325 | B1.0|REF97__V4|44996 | Bacteria | Bacteroidetes | Sphingobacteriia |
| 326 | B1.0|REF97__V4|4698 | Bacteria | Bacteroidetes | Sphingobacteriia |
| 327 | B1.0|REF99__V4|215418 | Bacteria | Bacteroidetes | Sphingobacteriia |
| 328 | B1.0|REF99__V4|120091 | Bacteria | Bacteroidetes | Sphingobacteriia |
| 329 | B1.0|REF99__V4|13091 | Bacteria | Bacteroidetes | Sphingobacteriia |
| 330 | B1.0|REF97__V4|82159 | Bacteria | Bacteroidetes | Sphingobacteriia |
| 331 | B1.0|REF99__V4|24509 | Bacteria | Bacteroidetes | Sphingobacteriia |
| 332 | B1.0|REF99__V4|10068, B1.0|REF97__V4|10068 | Bacteria | Bacteroidetes | Sphingobacteriia |
| 333 | B1.0|REF99__V4|131691 | Bacteria | Bacteroidetes | Sphingobacteriia |
| 334 | B1.0|REF99__V4|9277 | Bacteria | Bacteroidetes | Sphingobacteriia |
| 335 | B1.0|REF99__V4|211143, B1.0|REF97__V4|211143 | Bacteria | Bacteroidetes | Sphingobacteriia |
| 336 | B1.0|REF99__V4|131853 | Bacteria | Bacteroidetes | Sphingobacteriia |

TABLE 17-continued

Phylogeny and OTU designation of the endophytes useful for use in the present invention.

| | | | | |
|---|---|---|---|---|
| 337 | B1.0|REF99__V4|180548 | Bacteria | Bacteroidetes | Sphingobacteriia |
| 338 | B1.0|REF99__V4|25244 | Bacteria | Bacteroidetes | Sphingobacteriia |
| 339 | B1.0|REF99__V4|136151 | Bacteria | Bacteroidetes | Sphingobacteriia |
| 340 | B1.0|REF97__V4|8575 | Bacteria | Bacteroidetes | Sphingobacteriia |
| 341 | B1.0|REF99__V4|235382 | Bacteria | Bacteroidetes | Sphingobacteriia |
| 342 | B1.0|REF99__V4|3387 | Bacteria | Bacteroidetes | Sphingobacteriia |
| 343 | B1.0|REF97__V4|5719 | Bacteria | Bacteroidetes | Sphingobacteriia |
| 344 | B1.0|REF99__V4|200491 | Bacteria | Bacteroidetes | Sphingobacteriia |
| 345 | B1.0|REF97__V4|72887 | Bacteria | Bacteroidetes | Sphingobacteriia |
| 346 | B1.0|REF97__V4|35947 | Bacteria | Bacteroidetes | Sphingobacteriia |
| 347 | B1.0|REF97__V4|180654 | Bacteria | Bacteroidetes | Sphingobacteriia |
| 348 | B1.0|REF97__V4|131810 | Bacteria | Bacteroidetes | Sphingobacteriia |
| 349 | B1.0|REF99__V4|220344 | Bacteria | Bacteroidetes | Sphingobacteriia |
| 350 | B1.0|REF97__V4|93765 | Bacteria | Bacteroidetes | Sphingobacteriia |
| 351 | B1.0|REF99__V4|18381 | Bacteria | Bacteroidetes | Sphingobacteriia |
| 352 | B1.0|REF97__V4|44217 | Bacteria | Bacteroidetes | Sphingobacteriia |
| 353 | B1.0|REF99__V4|9861 | Bacteria | Bacteroidetes | Sphingobacteriia |
| 354 | B1.0|REF99__V4|11274, B1.0|REF97__V4|11274 | Bacteria | Bacteroidetes | Sphingobacteriia |
| 355 | B1.0|REF99__V4|14487, B1.0|REF97__V4|14487 | Bacteria | Bacteroidetes | Sphingobacteriia |
| 356 | B1.0|REF99__V4|33332 | Bacteria | Bacteroidetes | Sphingobacteriia |
| 357 | B1.0|REF99__V4|4534 | Bacteria | Bacteroidetes | Sphingobacteriia |
| 358 | B1.0|REF99__V4|8306 | Bacteria | Bacteroidetes | Sphingobacteriia |
| 359 | B1.0|REF99__V4|25293 | Bacteria | Bacteroidetes | Sphingobacteriia |
| 360 | B1.0|REF99__V4|15637 | Bacteria | Bacteroidetes | Sphingobacteriia |
| 361 | B1.0|REF99__V4|242808 | Bacteria | Bacteroidetes | Sphingobacteriia |
| 362 | B1.0|REF97__V4|94244 | Bacteria | Bacteroidetes | Sphingobacteriia |
| 363 | B1.0|REF99__V4|7289 | Bacteria | Bacteroidetes | Sphingobacteriia |
| 364 | B1.0|REF99__V4|57784 | Bacteria | Bacteroidetes | Sphingobacteriia |
| 365 | B1.0|REF99__V4|131335 | Bacteria | Bacteroidetes | Sphingobacteriia |
| 366 | B1.0|REF99__V4|145914, B1.0|REF97__V4|145914 | Bacteria | Bacteroidetes | Sphingobacteriia |
| 367 | B1.0|REF99__V4|126266 | Bacteria | Bacteroidetes | Sphingobacteriia |
| 368 | B1.0|REF99__V4|111274 | Bacteria | Bacteroidetes | Sphingobacteriia |
| 369 | B1.0|REF99__V4|35293 | Bacteria | Bacteroidetes | Sphingobacteriia |
| 370 | B1.0|REF99__V4|91824 | Bacteria | Bacteroidetes | Sphingobacteriia |
| 371 | B1.0|REF99__V4|5172 | Bacteria | Bacteroidetes | Sphingobacteriia |
| 372 | B1.0|REF99__V4|10206 | Bacteria | Bacteroidetes | Sphingobacteriia |
| 373 | B1.0|REF99__V4|55833 | Bacteria | Bacteroidetes | Sphingobacteriia |
| 374 | B1.0|REF99__V4|215056 | Bacteria | Bacteroidetes | Sphingobacteriia |
| 375 | B1.0|REF99__V4|109817 | Bacteria | Bacteroidetes | Sphingobacteriia |
| 376 | B1.0|REF97__V4|123381 | Bacteria | Bacteroidetes | Sphingobacteriia |
| 377 | B1.0|REF99__V4|146782 | Bacteria | Bacteroidetes | Sphingobacteriia |
| 378 | B1.0|REF99__V4|235018 | Bacteria | Bacteroidetes | Sphingobacteriia |
| 379 | B1.0|REF97__V4|109236 | Bacteria | Bacteroidetes | Sphingobacteriia |
| 380 | B1.0|REF99__V4|35252 | Bacteria | Bacteroidetes | Sphingobacteriia |
| 381 | B1.0|REF99__V4|79813 | Bacteria | Bacteroidetes | Sphingobacteriia |
| 382 | B1.0|REF99__V4|102724 | Bacteria | Bacteroidetes | Sphingobacteriia |
| 383 | B1.0|REF99__V4|234219 | Bacteria | Bacteroidetes | Sphingobacteriia |
| 384 | B1.0|REF99__V4|67481 | Bacteria | Bacteroidetes | Sphingobacteriia |
| 385 | B1.0|REF99__V4|13226 | Bacteria | Bacteroidetes | Sphingobacteriia |
| 386 | B1.0|REF99__V4|4824, B1.0|REF97__V4|4824 | Bacteria | Bacteroidetes | Sphingobacteriia |
| 387 | B1.0|REF99__V4|61866 | Bacteria | Bacteroidetes | Sphingobacteriia |
| 388 | B1.0|REF99__V4|5893 | Bacteria | Bacteroidetes | Sphingobacteriia |
| 389 | B1.0|REF99__V4|1290 | Bacteria | Bacteroidetes | Sphingobacteriia |
| 390 | B1.0|REF99__V4|6970 | Bacteria | Bacteroidetes | Sphingobacteriia |
| 391 | B1.0|REF99__V4|80799 | Bacteria | Bacteroidetes | Sphingobacteriia |
| 392 | B1.0|REF99__V4|18227 | Bacteria | Bacteroidetes | Sphingobacteriia |
| 393 | B1.0|REF99__V4|69301 | Bacteria | Bacteroidetes | Sphingobacteriia |
| 394 | B1.0|REF99__V4|109291, B1.0|REF97__V4|109291 | Bacteria | Bacteroidetes | Sphingobacteriia |
| 395 | B1.0|REF99__V4|12948 | Bacteria | Bacteroidetes | Sphingobacteriia |
| 396 | B1.0|REF99__V4|41412 | Bacteria | Bacteroidetes | Sphingobacteriia |
| 397 | B1.0|REF99__V4|133091 | Bacteria | Bacteroidetes | Sphingobacteriia |
| 398 | B1.0|REF99__V4|44386, B1.0|REF97__V4|44386 | Bacteria | Bacteroidetes | Sphingobacteriia |
| 399 | B1.0|REF99__V4|145707, B1.0|REF97__V4|145707 | Bacteria | Bacteroidetes | Sphingobacteriia |
| 400 | B1.0|REF99__V4|49902, B1.0|REF97__V4|49902 | Bacteria | Bacteroidetes | Sphingobacteriia |
| 401 | B1.0|REF99__V4|11397 | Bacteria | Bacteroidetes | Sphingobacteriia |
| 402 | B1.0|REF99__V4|7491 | Bacteria | Bacteroidetes | Sphingobacteriia |
| 403 | B1.0|REF99__V4|52385 | Bacteria | Bacteroidetes | Sphingobacteriia |
| 404 | B1.0|REF99__V4|11210 | Bacteria | Bacteroidetes | Sphingobacteriia |
| 405 | B1.0|REF99__V4|13726 | Bacteria | Bacteroidetes | Sphingobacteriia |
| 406 | B1.0|REF99__V4|201874 | Bacteria | Bacteroidetes | Sphingobacteriia |

TABLE 17-continued

Phylogeny and OTU designation of the endophytes useful for use in the present invention.

| | | | | |
|---|---|---|---|---|
| 407 | B1.0|REF99__V4|15416 | Bacteria | Bacteroidetes | Sphingobacteriia |
| 408 | B1.0|REF99__V4|123442 | Bacteria | Bacteroidetes | Sphingobacteriia |
| 409 | B1.0|REF99__V4|105757 | Bacteria | Bacteroidetes | Sphingobacteriia |
| 410 | B1.0|REF99__V4|96590 | Bacteria | Bacteroidetes | Sphingobacteriia |
| 411 | B1.0|REF99__V4|226 | Bacteria | Bacteroidetes | Sphingobacteriia |
| 412 | B1.0|REF99__V4|23534 | Bacteria | Bacteroidetes | Sphingobacteriia |
| 413 | B1.0|REF99__V4|572 | Bacteria | Bacteroidetes | Sphingobacteriia |
| 414 | B1.0|REF99__V4|23057 | Bacteria | Bacteroidetes | Sphingobacteriia |
| 415 | B1.0|REF99__V4|5878 | Bacteria | Bacteroidetes | Sphingobacteriia |
| 416 | B1.0|REF99__V4|2729 | Bacteria | Bacteroidetes | Sphingobacteriia |
| 417 | B1.0|REF99__V4|97336, B1.0|REF97__V4|97336 | Bacteria | Bacteroidetes | Sphingobacteriia |
| 418 | B1.0|REF99__V4|26046 | Bacteria | Bacteroidetes | Sphingobacteriia |
| 419 | B1.0|REF99__V4|20621 | Bacteria | Bacteroidetes | Sphingobacteriia |
| 420 | B1.0|REF99__V4|87673 | Bacteria | Bacteroidetes | Sphingobacteriia |
| 421 | B1.0|REF99__V4|1762 | Bacteria | Bacteroidetes | Sphingobacteriia |
| 422 | B1.0|REF99__V4|5440 | Bacteria | Bacteroidetes | Sphingobacteriia |
| 423 | B1.0|REF99__V4|632, B1.0|REF97__V4|632 | Bacteria | Bacteroidetes | Sphingobacteriia |
| 424 | B1.0|REF99__V4|168068 | Bacteria | Bacteroidetes | Sphingobacteriia |
| 425 | B1.0|REF99__V4|143087 | Bacteria | Bacteroidetes | Sphingobacteriia |
| 426 | B1.0|REF99__V4|22383, B1.0|REF97__V4|22383 | Bacteria | Bacteroidetes | Sphingobacteriia |
| 427 | B1.0|REF97__V4|6111 | Bacteria | Bacteroidetes | Sphingobacteriia |
| 428 | B1.0|REF99__V4|4504, B1.0|REF97__V4|4504 | Bacteria | Bacteroidetes | Sphingobacteriia |
| 429 | B1.0|REF99__V4|12985, B1.0|REF97__V4|12985 | Bacteria | Bacteroidetes | Sphingobacteriia |
| 430 | B1.0|REF99__V4|659, B1.0|REF97__V4|659 | Bacteria | Bacteroidetes | Sphingobacteriia |
| 431 | B1.0|REF99__V4|418 | Bacteria | Bacteroidetes | Sphingobacteriia |
| 432 | B1.0|REF99__V4|107877, B1.0|REF97__V4|107877 | Bacteria | Bacteroidetes | Sphingobacteriia |
| 433 | B1.0|REF97__V4|207806 | Bacteria | Bacteroidetes | Sphingobacteriia |
| 434 | B1.0|REF97__V4|67770 | Bacteria | Bacteroidetes | VC2.1__Bac22 |
| 435 | B1.0|SYM97__V4|47 | Bacteria | Bacteroidetes | |
| 436 | B1.0|REF99__V4|148636 | Bacteria | Candidate__division__TM7 | |
| 437 | B1.0|SYM97__V4|55 | Bacteria | Chlamydiae | Chlamydiia |
| 438 | B1.0|REF97__V4|61915 | Bacteria | Chlamydiae | Chlamydiia |
| 439 | B1.0|REF97__V4|133452 | Bacteria | Chloroflexi | Anaerolineae |
| 440 | B1.0|REF97__V4|148378 | Bacteria | Chloroflexi | Anaerolineae |
| 441 | B1.0|REF99__V4|78264, B1.0|REF97__V4|78264 | Bacteria | Chloroflexi | Anaerolineae |
| 442 | B1.0|REF97__V4|80267 | Bacteria | Chloroflexi | Anaerolineae |
| 443 | B1.0|REF97__V4|53912 | Bacteria | Chloroflexi | Anaerolineae |
| 444 | B1.0|REF97__V4|199421 | Bacteria | Chloroflexi | Anaerolineae |
| 445 | B1.0|REF99__V4|60372 | Bacteria | Chloroflexi | Anaerolineae |
| 446 | B1.0|REF97__V4|17955 | Bacteria | Chloroflexi | Anaerolineae |
| 447 | B1.0|REF97__V4|82656 | Bacteria | Chloroflexi | Chloroflexia |
| 448 | B1.0|REF97__V4|53950 | Bacteria | Chloroflexi | Chloroflexia |
| 449 | B1.0|REF99__V4|80223 | Bacteria | Chloroflexi | KD4-96 |
| 450 | B1.0|REF99__V4|214598 | Bacteria | Chloroflexi | Thermomicrobia |
| 451 | B1.0|REF99__V4|43256 | Bacteria | Chloroflexi | Thermomicrobia |
| 452 | B1.0|REF97__V4|46836 | Bacteria | Chloroflexi | TK10 |
| 453 | B1.0|REF97__V4|106347 | Bacteria | Chloroflexi | TK10 |
| 454 | B1.0|REF97__V4|29055 | Bacteria | Cyanobacteria | Cyanobacteria |
| 455 | B1.0|REF99__V4|3835 | Bacteria | Cyanobacteria | Cyanobacteria |
| 456 | B1.0|REF99__V4|19681 | Bacteria | Cyanobacteria | Cyanobacteria |
| 457 | B1.0|REF99__V4|28349 | Bacteria | Cyanobacteria | Melainabacteria |
| 458 | B1.0|REF99__V4|68285 | Bacteria | Deinococcus-Thermus | Deinococci |
| 459 | B1.0|REF97__V4|143344 | Bacteria | Fibrobacteres | Fibrobacteria |
| 460 | B1.0|REF99__V4|177738, B1.0|REF97__V4|177738 | Bacteria | Fibrobacteres | Fibrobacteria |
| 461 | B1.0|REF97__V4|212628 | Bacteria | Fibrobacteres | Fibrobacteria |
| 462 | B1.0|REF97__V4|106695 | Bacteria | Fibrobacteres | Fibrobacteria |
| 463 | B1.0|REF97__V4|145353 | Bacteria | Fibrobacteres | Fibrobacteria |
| 464 | B1.0|REF97__V4|200428 | Bacteria | Fibrobacteres | Fibrobacteria |
| 465 | B1.0|REF99__V4|91823 | Bacteria | Fibrobacteres | Fibrobacteria |
| 466 | B1.0|REF99__V4|22452 | Bacteria | Firmicutes | Bacilli |
| 467 | B1.0|REF99__V4|57786 | Bacteria | Firmicutes | Bacilli |
| 468 | B1.0|REF97__V4|34582 | Bacteria | Firmicutes | Bacilli |
| 469 | B1.0|REF99__V4|123 | Bacteria | Firmicutes | Bacilli |
| 470 | B1.0|REF99__V4|966 | Bacteria | Firmicutes | Bacilli |
| 471 | B1.0|REF99__V4|151 | Bacteria | Firmicutes | Bacilli |
| 472 | B1.0|REF99__V4|512, B1.0|REF97__V4|512 | Bacteria | Firmicutes | Bacilli |
| 473 | B1.0|REF99__V4|392 | Bacteria | Firmicutes | Bacilli |
| 474 | B1.0|REF99__V4|52829 | Bacteria | Firmicutes | Bacilli |

TABLE 17-continued

Phylogeny and OTU designation of the endophytes useful for use in the present invention.

| | | | | |
|---|---|---|---|---|
| 475 | B1.0|REF99__V4|3130 | Bacteria | Firmicutes | Bacilli |
| 476 | B1.0|REF99__V4|513 | Bacteria | Firmicutes | Bacilli |
| 477 | B1.0|REF99__V4|535 | Bacteria | Firmicutes | Bacilli |
| 478 | B1.0|REF99__V4|149, B1.0|REF97__V4|149 | Bacteria | Firmicutes | Bacilli |
| 479 | B1.0|REF99__V4|107512 | Bacteria | Firmicutes | Bacilli |
| 480 | B1.0|REF97__V4|536 | Bacteria | Firmicutes | Bacilli |
| 481 | B1.0|REF99__V4|28072 | Bacteria | Firmicutes | Bacilli |
| 482 | B1.0|REF99__V4|13123 | Bacteria | Firmicutes | Bacilli |
| 483 | B1.0|REF99__V4|17 | Bacteria | Firmicutes | Bacilli |
| 484 | B1.0|REF97__V4|159363 | Bacteria | Firmicutes | Bacilli |
| 485 | B1.0|REF99__V4|299 | Bacteria | Firmicutes | Bacilli |
| 486 | B1.0|REF99__V4|88954 | Bacteria | Firmicutes | Bacilli |
| 487 | B1.0|REF99__V4|3933 | Bacteria | Firmicutes | Bacilli |
| 488 | B1.0|REF99__V4|16802 | Bacteria | Firmicutes | Bacilli |
| 489 | B1.0|REF99__V4|774 | Bacteria | Firmicutes | Bacilli |
| 490 | B1.0|REF97__V4|8090 | Bacteria | Firmicutes | Bacilli |
| 491 | B1.0|REF99__V4|4779 | Bacteria | Firmicutes | Bacilli |
| 492 | B1.0|REF97__V4|9806 | Bacteria | Firmicutes | Bacilli |
| 493 | B1.0|SYM97__V4|845 | Bacteria | Firmicutes | Bacilli |
| 494 | B1.0|REF99__V4|72641 | Bacteria | Firmicutes | Bacilli |
| 495 | B1.0|REF99__V4|9 | Bacteria | Firmicutes | Bacilli |
| 496 | B1.0|REF99__V4|70, B1.0|REF97__V4|70 | Bacteria | Firmicutes | Bacilli |
| 497 | B1.0|REF99__V4|843 | Bacteria | Firmicutes | Bacilli |
| 498 | B1.0|REF99__V4|1749 | Bacteria | Firmicutes | Bacilli |
| 499 | B1.0|REF99__V4|1098, B1.0|REF97__V4|1098 | Bacteria | Firmicutes | Bacilli |
| 500 | B1.0|REF99__V4|806 | Bacteria | Firmicutes | Bacilli |
| 501 | B1.0|REF99__V4|4206 | Bacteria | Firmicutes | Bacilli |
| 502 | B1.0|REF99__V4|162750 | Bacteria | Firmicutes | Bacilli |
| 503 | B1.0|REF99__V4|4190 | Bacteria | Firmicutes | Bacilli |
| 504 | B1.0|REF99__V4|175028 | Bacteria | Firmicutes | Bacilli |
| 505 | B1.0|REF99__V4|7082 | Bacteria | Firmicutes | Bacilli |
| 506 | B1.0|REF99__V4|951 | Bacteria | Firmicutes | Bacilli |
| 507 | B1.0|REF99__V4|5079 | Bacteria | Firmicutes | Bacilli |
| 508 | B1.0|REF99__V4|3825 | Bacteria | Firmicutes | Bacilli |
| 509 | B1.0|REF99__V4|108146 | Bacteria | Firmicutes | Bacilli |
| 510 | B1.0|REF99__V4|8981, B1.0|REF97__V4|8981 | Bacteria | Firmicutes | Bacilli |
| 511 | B1.0|REF99__V4|2215 | Bacteria | Firmicutes | Bacilli |
| 512 | B1.0|REF99__V4|15428 | Bacteria | Firmicutes | Bacilli |
| 513 | B1.0|REF99__V4|6745 | Bacteria | Firmicutes | Bacilli |
| 514 | B1.0|REF99__V4|186 | Bacteria | Firmicutes | Bacilli |
| 515 | B1.0|REF97__V4|216859 | Bacteria | Firmicutes | Bacilli |
| 516 | B1.0|REF99__V4|682 | Bacteria | Firmicutes | Bacilli |
| 517 | B1.0|REF99__V4|14293 | Bacteria | Firmicutes | Bacilli |
| 518 | B1.0|REF99__V4|34780 | Bacteria | Firmicutes | Bacilli |
| 519 | B1.0|REF99__V4|35285, B1.0|REF97__V4|35285 | Bacteria | Firmicutes | Bacilli |
| 520 | B1.0|REF99__V4|107542 | Bacteria | Firmicutes | Bacilli |
| 521 | B1.0|REF99__V4|2169, B1.0|REF97__V4|2169 | Bacteria | Firmicutes | Bacilli |
| 522 | B1.0|REF99__V4|19799 | Bacteria | Firmicutes | Bacilli |
| 523 | B1.0|REF97__V4|120599 | Bacteria | Firmicutes | Bacilli |
| 524 | B1.0|REF99__V4|23207 | Bacteria | Firmicutes | Bacilli |
| 525 | B1.0|REF99__V4|122558 | Bacteria | Firmicutes | Bacilli |
| 526 | B1.0|REF99__V4|474 | Bacteria | Firmicutes | Bacilli |
| 527 | B1.0|REF99__V4|66392, B1.0|REF97__V4|66392 | Bacteria | Firmicutes | Bacilli |
| 528 | B1.0|REF99__V4|8960 | Bacteria | Firmicutes | Bacilli |
| 529 | B1.0|REF99__V4|3983 | Bacteria | Firmicutes | Bacilli |
| 530 | B1.0|REF99__V4|16675, B1.0|REF97__V4|16675 | Bacteria | Firmicutes | Bacilli |
| 531 | B1.0|REF99__V4|2332 | Bacteria | Firmicutes | Bacilli |
| 532 | B1.0|REF99__V4|7841 | Bacteria | Firmicutes | Bacilli |
| 533 | B1.0|REF99__V4|69685, B1.0|REF97__V4|69685 | Bacteria | Firmicutes | Bacilli |
| 534 | B1.0|REF99__V4|11504 | Bacteria | Firmicutes | Bacilli |
| 535 | B1.0|REF99__V4|11976 | Bacteria | Firmicutes | Bacilli |
| 536 | B1.0|REF99__V4|842 | Bacteria | Firmicutes | Bacilli |
| 537 | B1.0|REF99__V4|13031 | Bacteria | Firmicutes | Bacilli |
| 538 | B1.0|REF99__V4|131917 | Bacteria | Firmicutes | Bacilli |
| 539 | B1.0|REF99__V4|5139 | Bacteria | Firmicutes | Bacilli |
| 540 | B1.0|REF99__V4|18, B1.0|REF97__V4|18 | Bacteria | Firmicutes | Bacilli |
| 541 | B1.0|REF99__V4|2599 | Bacteria | Firmicutes | Bacilli |
| 542 | B1.0|REF99__V4|873 | Bacteria | Firmicutes | Bacilli |

TABLE 17-continued

Phylogeny and OTU designation of the endophytes useful for use in the present invention.

| | | | | |
|---|---|---|---|---|
| 543 | B1.0|REF99_V4|3668 | Bacteria | Firmicutes | Bacilli |
| 544 | B1.0|REF99_V4|165502 | Bacteria | Firmicutes | Bacilli |
| 545 | B1.0|REF99_V4|120407 | Bacteria | Firmicutes | Bacilli |
| 546 | B1.0|REF99_V4|24681 | Bacteria | Firmicutes | Bacilli |
| 547 | B1.0|REF99_V4|3339 | Bacteria | Firmicutes | Bacilli |
| 548 | B1.0|REF99_V4|156799 | Bacteria | Firmicutes | Bacilli |
| 549 | B1.0|REF99_V4|323 | Bacteria | Firmicutes | Bacilli |
| 550 | B1.0|REF99_V4|4956 | Bacteria | Firmicutes | Bacilli |
| 551 | B1.0|SYM97_V4|984 | Bacteria | Firmicutes | Bacilli |
| 552 | B1.0|REF99_V4|18597 | Bacteria | Firmicutes | Bacilli |
| 553 | B1.0|REF99_V4|480 | Bacteria | Firmicutes | Bacilli |
| 554 | B1.0|REF99_V4|24207 | Bacteria | Firmicutes | Bacilli |
| 555 | B1.0|REF99_V4|9066 | Bacteria | Firmicutes | Bacilli |
| 556 | B1.0|REF99_V4|11867 | Bacteria | Firmicutes | Bacilli |
| 557 | B1.0|REF99_V4|1423 | Bacteria | Firmicutes | Bacilli |
| 558 | B1.0|REF99_V4|1635, B1.0|REF97_V4|1635 | Bacteria | Firmicutes | Bacilli |
| 559 | B1.0|REF99_V4|111 | Bacteria | Firmicutes | Bacilli |
| 560 | B1.0|REF99_V4|532 | Bacteria | Firmicutes | Bacilli |
| 561 | B1.0|REF99_V4|242 | Bacteria | Firmicutes | Bacilli |
| 562 | B1.0|REF99_V4|402 | Bacteria | Firmicutes | Bacilli |
| 563 | B1.0|REF99_V4|44943, B1.0|REF97_V4|44943 | Bacteria | Firmicutes | Clostridia |
| 564 | B1.0|REF99_V4|3624, B1.0|REF97_V4|3624 | Bacteria | Firmicutes | Clostridia |
| 565 | B1.0|REF99_V4|10503, B1.0|REF97_V4|10503 | Bacteria | Firmicutes | Clostridia |
| 566 | B1.0|REF99_V4|16938, B1.0|REF97_V4|16938 | Bacteria | Firmicutes | Clostridia |
| 567 | B1.0|REF99_V4|21364 | Bacteria | Firmicutes | Clostridia |
| 568 | B1.0|REF99_V4|285 | Bacteria | Firmicutes | Clostridia |
| 569 | B1.0|REF99_V4|5988, B1.0|REF97_V4|5988 | Bacteria | Firmicutes | Clostridia |
| 570 | B1.0|REF99_V4|7171 | Bacteria | Firmicutes | Clostridia |
| 571 | B1.0|REF99_V4|708 | Bacteria | Firmicutes | Clostridia |
| 572 | B1.0|REF99_V4|7072 | Bacteria | Firmicutes | Clostridia |
| 573 | B1.0|REF99_V4|162390 | Bacteria | Firmicutes | Clostridia |
| 574 | B1.0|REF99_V4|6656 | Bacteria | Firmicutes | Clostridia |
| 575 | B1.0|REF99_V4|547 | Bacteria | Firmicutes | Clostridia |
| 576 | B1.0|REF99_V4|18134 | Bacteria | Firmicutes | Clostridia |
| 577 | B1.0|REF99_V4|5476 | Bacteria | Firmicutes | Clostridia |
| 578 | B1.0|REF99_V4|161242 | Bacteria | Firmicutes | Clostridia |
| 579 | B1.0|REF99_V4|1316 | Bacteria | Firmicutes | Clostridia |
| 580 | B1.0|REF99_V4|14553 | Bacteria | Firmicutes | Clostridia |
| 581 | B1.0|REF99_V4|1006 | Bacteria | Firmicutes | Negativicutes |
| 582 | B1.0|REF99_V4|13768 | Bacteria | Firmicutes | Negativicutes |
| 583 | B1.0|REF99_V4|766 | Bacteria | Firmicutes | Negativicutes |
| 584 | B1.0|REF99_V4|2163 | Bacteria | Fusobacteria | Fusobacteriia |
| 585 | B1.0|REF97_V4|140974 | Bacteria | Gemmatimonadetes | Gemmatimonadetes |
| 586 | B1.0|REF97_V4|18991 | Bacteria | Gemmatimonadetes | Gemmatimonadetes |
| 587 | B1.0|REF99_V4|29403 | Bacteria | Gemmatimonadetes | Gemmatimonadetes |
| 588 | B1.0|REF97_V4|127013 | Bacteria | Gemmatimonadetes | Gemmatimonadetes |
| 589 | B1.0|REF99_V4|216944 | Bacteria | Gemmatimonadetes | Gemmatimonadetes |
| 590 | B1.0|REF99_V4|72300 | Bacteria | Gemmatimonadetes | Gemmatimonadetes |
| 591 | B1.0|REF99_V4|17750 | Bacteria | Gemmatimonadetes | Gemmatimonadetes |
| 592 | B1.0|REF97_V4|216829 | Bacteria | Gemmatimonadetes | Gemmatimonadetes |
| 593 | B1.0|REF99_V4|32841 | Bacteria | Gemmatimonadetes | Gemmatimonadetes |
| 594 | B1.0|REF99_V4|79852, B1.0|REF97_V4|79852 | Bacteria | Gemmatimonadetes | Gemmatimonadetes |
| 595 | B1.0|REF99_V4|12612, B1.0|REF97_V4|12612 | Bacteria | Gemmatimonadetes | Gemmatimonadetes |
| 596 | B1.0|REF97_V4|234249 | Bacteria | Gemmatimonadetes | Gemmatimonadetes |
| 597 | B1.0|REF99_V4|134040 | Bacteria | Gemmatimonadetes | Gemmatimonadetes |
| 598 | B1.0|REF97_V4|84806 | Bacteria | Gemmatimonadetes | Gemmatimonadetes |
| 599 | B1.0|REF97_V4|243523 | Bacteria | Planctomycetes | OM190 |
| 600 | B1.0|REF97_V4|37428 | Bacteria | Planctomycetes | Phycisphaerae |
| 601 | B1.0|REF99_V4|160327 | Bacteria | Planctomycetes | Phycisphaerae |
| 602 | B1.0|REF97_V4|30702 | Bacteria | Planctomycetes | Planctomycetacia |
| 603 | B1.0|REF97_V4|190667 | Bacteria | Planctomycetes | Planctomycetacia |
| 604 | B1.0|REF97_V4|22082 | Bacteria | Planctomycetes | Planctomycetacia |
| 605 | B1.0|REF97_V4|33087 | Bacteria | Planctomycetes | Planctomycetacia |
| 606 | B1.0|REF99_V4|214823 | Bacteria | Planctomycetes | Planctomycetacia |
| 607 | B1.0|REF97_V4|180428 | Bacteria | Planctomycetes | Planctomycetacia |
| 608 | B1.0|REF97_V4|36587 | Bacteria | Planctomycetes | Planctomycetia |
| 609 | B1.0|REF99_V4|24215 | Bacteria | Planctomycetes | vadinHA49 |
| 610 | B1.0|REF97_V4|173848 | Bacteria | Proteobacteria | Alphaproteobacteria |
| 611 | B1.0|REF99_V4|4856 | Bacteria | Proteobacteria | Alphaproteobacteria |
| 612 | B1.0|REF99_V4|630 | Bacteria | Proteobacteria | Alphaproteobacteria |

TABLE 17-continued

Phylogeny and OTU designation of the endophytes useful for use in the present invention.

| | | | | |
|---|---|---|---|---|
| 613 | B1.0\|REF99__V4\|2200 | Bacteria | Proteobacteria | Alphaproteobacteria |
| 614 | B1.0\|REF97__V4\|55593 | Bacteria | Proteobacteria | Alphaproteobacteria |
| 615 | B1.0\|REF99__V4\|3374, B1.0\|REF97__V4\|3374 | Bacteria | Proteobacteria | Alphaproteobacteria |
| 616 | B1.0\|REF99__V4\|2535 | Bacteria | Proteobacteria | Alphaproteobacteria |
| 617 | B1.0\|REF99__V4\|1166 | Bacteria | Proteobacteria | Alphaproteobacteria |
| 618 | B1.0\|REF99__V4\|88504 | Bacteria | Proteobacteria | Alphaproteobacteria |
| 619 | B1.0\|REF99__V4\|4527 | Bacteria | Proteobacteria | Alphaproteobacteria |
| 620 | B1.0\|REF99__V4\|8554, B1.0\|REF97__V4\|8554 | Bacteria | Proteobacteria | Alphaproteobacteria |
| 621 | B1.0\|REF99__V4\|569 | Bacteria | Proteobacteria | Alphaproteobacteria |
| 622 | B1.0\|REF99__V4\|1005 | Bacteria | Proteobacteria | Alphaproteobacteria |
| 623 | B1.0\|REF97__V4\|436 | Bacteria | Proteobacteria | Alphaproteobacteria |
| 624 | B1.0\|REF99__V4\|146833 | Bacteria | Proteobacteria | Alphaproteobacteria |
| 625 | B1.0\|REF99__V4\|893 | Bacteria | Proteobacteria | Alphaproteobacteria |
| 626 | B1.0\|REF99__V4\|577 | Bacteria | Proteobacteria | Alphaproteobacteria |
| 627 | B1.0\|REF99__V4\|1286 | Bacteria | Proteobacteria | Alphaproteobacteria |
| 628 | B1.0\|REF99__V4\|136920 | Bacteria | Proteobacteria | Alphaproteobacteria |
| 629 | B1.0\|REF99__V4\|24845 | Bacteria | Proteobacteria | Alphaproteobacteria |
| 630 | B1.0\|REF97__V4\|79407 | Bacteria | Proteobacteria | Alphaproteobacteria |
| 631 | B1.0\|REF99__V4\|2675 | Bacteria | Proteobacteria | Alphaproteobacteria |
| 632 | B1.0\|REF99__V4\|5228, B1.0\|REF97__V4\|5228 | Bacteria | Proteobacteria | Alphaproteobacteria |
| 633 | B1.0\|REF99__V4\|15702 | Bacteria | Proteobacteria | Alphaproteobacteria |
| 634 | B1.0\|REF97__V4\|25310 | Bacteria | Proteobacteria | Alphaproteobacteria |
| 635 | B1.0\|REF99__V4\|18373 | Bacteria | Proteobacteria | Alphaproteobacteria |
| 636 | B1.0\|REF99__V4\|12315 | Bacteria | Proteobacteria | Alphaproteobacteria |
| 637 | B1.0\|REF99__V4\|201864 | Bacteria | Proteobacteria | Alphaproteobacteria |
| 638 | B1.0\|REF99__V4\|8102 | Bacteria | Proteobacteria | Alphaproteobacteria |
| 639 | B1.0\|REF99__V4\|177466 | Bacteria | Proteobacteria | Alphaproteobacteria |
| 640 | B1.0\|REF99__V4\|211419 | Bacteria | Proteobacteria | Alphaproteobacteria |
| 641 | B1.0\|REF99__V4\|164244 | Bacteria | Proteobacteria | Alphaproteobacteria |
| 642 | B1.0\|REF99__V4\|108061 | Bacteria | Proteobacteria | Alphaproteobacteria |
| 643 | B1.0\|REF99__V4\|176246 | Bacteria | Proteobacteria | Alphaproteobacteria |
| 644 | B1.0\|REF99__V4\|7232 | Bacteria | Proteobacteria | Alphaproteobacteria |
| 645 | B1.0\|REF99__V4\|217464 | Bacteria | Proteobacteria | Alphaproteobacteria |
| 646 | B1.0\|REF99__V4\|2611 | Bacteria | Proteobacteria | Alphaproteobacteria |
| 647 | B1.0\|REF99__V4\|1873 | Bacteria | Proteobacteria | Alphaproteobacteria |
| 648 | B1.0\|REF99__V4\|14 | Bacteria | Proteobacteria | Alphaproteobacteria |
| 649 | B1.0\|REF99__V4\|1059 | Bacteria | Proteobacteria | Alphaproteobacteria |
| 650 | B1.0\|REF99__V4\|7621 | Bacteria | Proteobacteria | Alphaproteobacteria |
| 651 | B1.0\|REF99__V4\|118019 | Bacteria | Proteobacteria | Alphaproteobacteria |
| 652 | B1.0\|REF99__V4\|7290 | Bacteria | Proteobacteria | Alphaproteobacteria |
| 653 | B1.0\|REF99__V4\|995 | Bacteria | Proteobacteria | Alphaproteobacteria |
| 654 | B1.0\|REF99__V4\|237 | Bacteria | Proteobacteria | Alphaproteobacteria |
| 655 | B1.0\|REF99__V4\|928 | Bacteria | Proteobacteria | Alphaproteobacteria |
| 656 | B1.0\|REF99__V4\|191 | Bacteria | Proteobacteria | Alphaproteobacteria |
| 657 | B1.0\|REF99__V4\|4718 | Bacteria | Proteobacteria | Alphaproteobacteria |
| 658 | B1.0\|REF99__V4\|1252 | Bacteria | Proteobacteria | Alphaproteobacteria |
| 659 | B1.0\|REF99__V4\|14510 | Bacteria | Proteobacteria | Alphaproteobacteria |
| 660 | B1.0\|REF99__V4\|108251 | Bacteria | Proteobacteria | Alphaproteobacteria |
| 661 | B1.0\|REF97__V4\|111026 | Bacteria | Proteobacteria | Alphaproteobacteria |
| 662 | B1.0\|REF97__V4\|12357 | Bacteria | Proteobacteria | Alphaproteobacteria |
| 663 | B1.0\|REF99__V4\|5922 | Bacteria | Proteobacteria | Alphaproteobacteria |
| 664 | B1.0\|REF99__V4\|11463 | Bacteria | Proteobacteria | Alphaproteobacteria |
| 665 | B1.0\|REF99__V4\|446 | Bacteria | Proteobacteria | Alphaproteobacteria |
| 666 | B1.0\|REF99__V4\|74703 | Bacteria | Proteobacteria | Alphaproteobacteria |
| 667 | B1.0\|REF99__V4\|27208 | Bacteria | Proteobacteria | Alphaproteobacteria |
| 668 | B1.0\|REF99__V4\|63341 | Bacteria | Proteobacteria | Alphaproteobacteria |
| 669 | B1.0\|REF99__V4\|80181 | Bacteria | Proteobacteria | Alphaproteobacteria |
| 670 | B1.0\|REF99__V4\|10019 | Bacteria | Proteobacteria | Alphaproteobacteria |
| 671 | B1.0\|REF99__V4\|16704 | Bacteria | Proteobacteria | Alphaproteobacteria |
| 672 | B1.0\|REF99__V4\|24077 | Bacteria | Proteobacteria | Alphaproteobacteria |
| 673 | B1.0\|REF99__V4\|165373 | Bacteria | Proteobacteria | Alphaproteobacteria |
| 674 | B1.0\|REF99__V4\|21135, B1.0\|REF97__V4\|21135 | Bacteria | Proteobacteria | Alphaproteobacteria |
| 675 | B1.0\|REF99__V4\|2393 | Bacteria | Proteobacteria | Alphaproteobacteria |
| 676 | B1.0\|REF99__V4\|487, B1.0\|REF97__V4\|487 | Bacteria | Proteobacteria | Alphaproteobacteria |
| 677 | B1.0\|REF99__V4\|6086, B1.0\|REF97__V4\|6086 | Bacteria | Proteobacteria | Alphaproteobacteria |
| 678 | B1.0\|REF99__V4\|13904 | Bacteria | Proteobacteria | Alphaproteobacteria |
| 679 | B1.0\|REF99__V4\|156376 | Bacteria | Proteobacteria | Alphaproteobacteria |
| 680 | B1.0\|REF99__V4\|1950 | Bacteria | Proteobacteria | Alphaproteobacteria |
| 681 | B1.0\|REF99__V4\|234 | Bacteria | Proteobacteria | Alphaproteobacteria |
| 682 | B1.0\|REF99__V4\|107722 | Bacteria | Proteobacteria | Alphaproteobacteria |
| 683 | B1.0\|REF99__V4\|2385 | Bacteria | Proteobacteria | Alphaproteobacteria |
| 684 | B1.0\|REF99__V4\|172 | Bacteria | Proteobacteria | Alphaproteobacteria |

TABLE 17-continued

Phylogeny and OTU designation of the endophytes useful for use in the present invention.

| | | | | |
|---|---|---|---|---|
| 685 | B1.0|REF97__V4|73500 | Bacteria | Proteobacteria | Alphaproteobacteria |
| 686 | B1.0|REF99__V4|201781 | Bacteria | Proteobacteria | Alphaproteobacteria |
| 687 | B1.0|REF99__V4|4049 | Bacteria | Proteobacteria | Alphaproteobacteria |
| 688 | B1.0|REF99__V4|25052 | Bacteria | Proteobacteria | Alphaproteobacteria |
| 689 | B1.0|REF99__V4|2546 | Bacteria | Proteobacteria | Alphaproteobacteria |
| 690 | B1.0|REF99__V4|12637 | Bacteria | Proteobacteria | Alphaproteobacteria |
| 691 | B1.0|REF99__V4|2533 | Bacteria | Proteobacteria | Alphaproteobacteria |
| 692 | B1.0|REF99__V4|2304 | Bacteria | Proteobacteria | Alphaproteobacteria |
| 693 | B1.0|REF99__V4|22483 | Bacteria | Proteobacteria | Alphaproteobacteria |
| 694 | B1.0|REF99__V4|18948 | Bacteria | Proteobacteria | Alphaproteobacteria |
| 695 | B1.0|REF99__V4|14530 | Bacteria | Proteobacteria | Alphaproteobacteria |
| 696 | B1.0|REF99__V4|14891 | Bacteria | Proteobacteria | Alphaproteobacteria |
| 697 | B1.0|REF99__V4|162569 | Bacteria | Proteobacteria | Alphaproteobacteria |
| 698 | B1.0|REF99__V4|6636 | Bacteria | Proteobacteria | Alphaproteobacteria |
| 699 | B1.0|REF99__V4|16285 | Bacteria | Proteobacteria | Alphaproteobacteria |
| 700 | B1.0|REF97__V4|9552 | Bacteria | Proteobacteria | Alphaproteobacteria |
| 701 | B1.0|REF99__V4|3785 | Bacteria | Proteobacteria | Alphaproteobacteria |
| 702 | B1.0|REF99__V4|5579 | Bacteria | Proteobacteria | Alphaproteobacteria |
| 703 | B1.0|REF99__V4|2242 | Bacteria | Proteobacteria | Alphaproteobacteria |
| 704 | B1.0|REF99__V4|166805 | Bacteria | Proteobacteria | Alphaproteobacteria |
| 705 | B1.0|REF99__V4|10440 | Bacteria | Proteobacteria | Alphaproteobacteria |
| 706 | B1.0|REF99__V4|12451 | Bacteria | Proteobacteria | Alphaproteobacteria |
| 707 | B1.0|REF99__V4|126273 | Bacteria | Proteobacteria | Alphaproteobacteria |
| 708 | B1.0|REF99__V4|5826 | Bacteria | Proteobacteria | Alphaproteobacteria |
| 709 | B1.0|REF99__V4|97932 | Bacteria | Proteobacteria | Alphaproteobacteria |
| 710 | B1.0|REF99__V4|7237 | Bacteria | Proteobacteria | Alphaproteobacteria |
| 711 | B1.0|REF99__V4|197 | Bacteria | Proteobacteria | Alphaproteobacteria |
| 712 | B1.0|REF99__V4|228724 | Bacteria | Proteobacteria | Alphaproteobacteria |
| 713 | B1.0|REF99__V4|754 | Bacteria | Proteobacteria | Alphaproteobacteria |
| 714 | B1.0|REF99__V4|484 | Bacteria | Proteobacteria | Alphaproteobacteria |
| 715 | B1.0|REF99__V4|12147 | Bacteria | Proteobacteria | Alphaproteobacteria |
| 716 | B1.0|REF99__V4|11659 | Bacteria | Proteobacteria | Alphaproteobacteria |
| 717 | B1.0|REF99__V4|17223 | Bacteria | Proteobacteria | Alphaproteobacteria |
| 718 | B1.0|REF99__V4|620 | Bacteria | Proteobacteria | Alphaproteobacteria |
| 719 | B1.0|REF99__V4|385 | Bacteria | Proteobacteria | Alphaproteobacteria |
| 720 | B1.0|REF99__V4|13993 | Bacteria | Proteobacteria | Alphaproteobacteria |
| 721 | B1.0|REF99__V4|174886 | Bacteria | Proteobacteria | Alphaproteobacteria |
| 722 | B1.0|REF99__V4|2033 | Bacteria | Proteobacteria | Alphaproteobacteria |
| 723 | B1.0|REF99__V4|18581 | Bacteria | Proteobacteria | Alphaproteobacteria |
| 724 | B1.0|REF99__V4|970 | Bacteria | Proteobacteria | Alphaproteobacteria |
| 725 | B1.0|REF99__V4|162736 | Bacteria | Proteobacteria | Alphaproteobacteria |
| 726 | B1.0|REF99__V4|11767, B1.0|REF97__V4|11767 | Bacteria | Proteobacteria | Alphaproteobacteria |
| 727 | B1.0|REF99__V4|3042 | Bacteria | Proteobacteria | Alphaproteobacteria |
| 728 | B1.0|REF99__V4|19359 | Bacteria | Proteobacteria | Alphaproteobacteria |
| 729 | B1.0|REF99__V4|230 | Bacteria | Proteobacteria | Alphaproteobacteria |
| 730 | B1.0|REF99__V4|156338 | Bacteria | Proteobacteria | Alphaproteobacteria |
| 731 | B1.0|REF99__V4|3985 | Bacteria | Proteobacteria | Alphaproteobacteria |
| 732 | B1.0|REF99__V4|58778 | Bacteria | Proteobacteria | Alphaproteobacteria |
| 733 | B1.0|REF99__V4|142567 | Bacteria | Proteobacteria | Alphaproteobacteria |
| 734 | B1.0|REF99__V4|558, B1.0|REF97__V4|558 | Bacteria | Proteobacteria | Alphaproteobacteria |
| 735 | B1.0|REF99__V4|823 | Bacteria | Proteobacteria | Alphaproteobacteria |
| 736 | B1.0|REF99__V4|944 | Bacteria | Proteobacteria | Alphaproteobacteria |
| 737 | B1.0|REF99__V4|1797 | Bacteria | Proteobacteria | Alphaproteobacteria |
| 738 | B1.0|REF99__V4|2792 | Bacteria | Proteobacteria | Alphaproteobacteria |
| 739 | B1.0|REF99__V4|1562 | Bacteria | Proteobacteria | Alphaproteobacteria |
| 740 | B1.0|REF99__V4|117243 | Bacteria | Proteobacteria | Alphaproteobacteria |
| 741 | B1.0|REF97__V4|92509 | Bacteria | Proteobacteria | Alphaproteobacteria |
| 742 | B1.0|REF99__V4|9019 | Bacteria | Proteobacteria | Alphaproteobacteria |
| 743 | B1.0|REF99__V4|30605 | Bacteria | Proteobacteria | Alphaproteobacteria |
| 744 | B1.0|REF99__V4|25776 | Bacteria | Proteobacteria | Alphaproteobacteria |
| 745 | B1.0|REF99__V4|24246 | Bacteria | Proteobacteria | Alphaproteobacteria |
| 746 | B1.0|REF99__V4|24559 | Bacteria | Proteobacteria | Alphaproteobacteria |
| 747 | B1.0|REF99__V4|217221 | Bacteria | Proteobacteria | Alphaproteobacteria |
| 748 | B1.0|REF99__V4|200338 | Bacteria | Proteobacteria | Alphaproteobacteria |
| 749 | B1.0|REF99__V4|58852 | Bacteria | Proteobacteria | Alphaproteobacteria |
| 750 | B1.0|REF97__V4|32971 | Bacteria | Proteobacteria | Alphaproteobacteria |
| 751 | B1.0|REF99__V4|218912 | Bacteria | Proteobacteria | Alphaproteobacteria |
| 752 | B1.0|REF99__V4|180777 | Bacteria | Proteobacteria | Alphaproteobacteria |
| 753 | B1.0|REF99__V4|5314 | Bacteria | Proteobacteria | Alphaproteobacteria |
| 754 | B1.0|REF99__V4|24033 | Bacteria | Proteobacteria | Alphaproteobacteria |
| 755 | B1.0|REF99__V4|218223 | Bacteria | Proteobacteria | Alphaproteobacteria |
| 756 | B1.0|REF99__V4|1571, B1.0|REF97__V4|1571 | Bacteria | Proteobacteria | Alphaproteobacteria |
| 757 | B1.0|REF99__V4|11503 | Bacteria | Proteobacteria | Alphaproteobacteria |
| 758 | B1.0|REF99__V4|2573 | Bacteria | Proteobacteria | Alphaproteobacteria |
| 759 | B1.0|REF99__V4|201801 | Bacteria | Proteobacteria | Alphaproteobacteria |

TABLE 17-continued

Phylogeny and OTU designation of the endophytes useful for use in the present invention.

| | | | | |
|---|---|---|---|---|
| 760 | B1.0\|REF97__V4\|180787 | Bacteria | Proteobacteria | Alphaproteobacteria |
| 761 | B1.0\|REF97__V4\|36132 | Bacteria | Proteobacteria | Alphaproteobacteria |
| 762 | B1.0\|REF99__V4\|2662 | Bacteria | Proteobacteria | Alphaproteobacteria |
| 763 | B1.0\|REF99__V4\|197072 | Bacteria | Proteobacteria | Alphaproteobacteria |
| 764 | B1.0\|REF99__V4\|121771, B1.0\|REF97__V4\|121771 | Bacteria | Proteobacteria | Alphaproteobacteria |
| 765 | B1.0\|REF97__V4\|88612 | Bacteria | Proteobacteria | Alphaproteobacteria |
| 766 | B1.0\|REF97__V4\|11448 | Bacteria | Proteobacteria | Alphaproteobacteria |
| 767 | B1.0\|REF99__V4\|17916 | Bacteria | Proteobacteria | Alphaproteobacteria |
| 768 | B1.0\|REF99__V4\|6752, B1.0\|REF97__V4\|6752 | Bacteria | Proteobacteria | Alphaproteobacteria |
| 769 | B1.0\|REF99__V4\|93212 | Bacteria | Proteobacteria | Alphaproteobacteria |
| 770 | B1.0\|REF99__V4\|156000 | Bacteria | Proteobacteria | Alphaproteobacteria |
| 771 | B1.0\|REF99__V4\|136267 | Bacteria | Proteobacteria | Alphaproteobacteria |
| 772 | B1.0\|REF99__V4\|2784 | Bacteria | Proteobacteria | Alphaproteobacteria |
| 773 | B1.0\|REF99__V4\|180605 | Bacteria | Proteobacteria | Alphaproteobacteria |
| 774 | B1.0\|REF99__V4\|232375 | Bacteria | Proteobacteria | Alphaproteobacteria |
| 775 | B1.0\|REF99__V4\|635 | Bacteria | Proteobacteria | Alphaproteobacteria |
| 776 | B1.0\|REF99__V4\|180779 | Bacteria | Proteobacteria | Alphaproteobacteria |
| 777 | B1.0\|REF99__V4\|21802 | Bacteria | Proteobacteria | Alphaproteobacteria |
| 778 | B1.0\|REF99__V4\|121446 | Bacteria | Proteobacteria | Alphaproteobacteria |
| 779 | B1.0\|REF97__V4\|117924 | Bacteria | Proteobacteria | Alphaproteobacteria |
| 780 | B1.0\|REF97__V4\|74335 | Bacteria | Proteobacteria | Alphaproteobacteria |
| 781 | B1.0\|REF99__V4\|242828 | Bacteria | Proteobacteria | Alphaproteobacteria |
| 782 | B1.0\|REF99__V4\|231108 | Bacteria | Proteobacteria | Alphaproteobacteria |
| 783 | B1.0\|REF99__V4\|214061 | Bacteria | Proteobacteria | Alphaproteobacteria |
| 784 | B1.0\|REF97__V4\|24209 | Bacteria | Proteobacteria | Alphaproteobacteria |
| 785 | B1.0\|REF99__V4\|52536 | Bacteria | Proteobacteria | Alphaproteobacteria |
| 786 | B1.0\|REF99__V4\|3715 | Bacteria | Proteobacteria | Alphaproteobacteria |
| 787 | B1.0\|REF99__V4\|164647 | Bacteria | Proteobacteria | Alphaproteobacteria |
| 788 | B1.0\|REF97__V4\|5530 | Bacteria | Proteobacteria | Alphaproteobacteria |
| 789 | B1.0\|REF99__V4\|2172 | Bacteria | Proteobacteria | Alphaproteobacteria |
| 790 | B1.0\|REF99__V4\|5741 | Bacteria | Proteobacteria | Alphaproteobacteria |
| 791 | B1.0\|REF99__V4\|18712 | Bacteria | Proteobacteria | Alphaproteobacteria |
| 792 | B1.0\|REF99__V4\|26267 | Bacteria | Proteobacteria | Alphaproteobacteria |
| 793 | B1.0\|REF99__V4\|88875 | Bacteria | Proteobacteria | Alphaproteobacteria |
| 794 | B1.0\|REF99__V4\|769 | Bacteria | Proteobacteria | Alphaproteobacteria |
| 795 | B1.0\|REF99__V4\|3487 | Bacteria | Proteobacteria | Alphaproteobacteria |
| 796 | B1.0\|REF99__V4\|42574 | Bacteria | Proteobacteria | Alphaproteobacteria |
| 797 | B1.0\|REF99__V4\|5714 | Bacteria | Proteobacteria | Alphaproteobacteria |
| 798 | B1.0\|REF99__V4\|52491 | Bacteria | Proteobacteria | Alphaproteobacteria |
| 799 | B1.0\|REF99__V4\|5899 | Bacteria | Proteobacteria | Alphaproteobacteria |
| 800 | B1.0\|REF99__V4\|156812 | Bacteria | Proteobacteria | Alphaproteobacteria |
| 801 | B1.0\|REF99__V4\|8287 | Bacteria | Proteobacteria | Alphaproteobacteria |
| 802 | B1.0\|REF99__V4\|145647 | Bacteria | Proteobacteria | Alphaproteobacteria |
| 803 | B1.0\|REF99__V4\|31957 | Bacteria | Proteobacteria | Alphaproteobacteria |
| 804 | B1.0\|REF99__V4\|1838 | Bacteria | Proteobacteria | Alphaproteobacteria |
| 805 | B1.0\|REF99__V4\|15611 | Bacteria | Proteobacteria | Alphaproteobacteria |
| 806 | B1.0\|REF99__V4\|5410 | Bacteria | Proteobacteria | Alphaproteobacteria |
| 807 | B1.0\|REF99__V4\|1940 | Bacteria | Proteobacteria | Alphaproteobacteria |
| 808 | B1.0\|REF99__V4\|9972 | Bacteria | Proteobacteria | Alphaproteobacteria |
| 809 | B1.0\|REF99__V4\|74216 | Bacteria | Proteobacteria | Alphaproteobacteria |
| 810 | B1.0\|REF99__V4\|250 | Bacteria | Proteobacteria | Alphaproteobacteria |
| 811 | B1.0\|REF99__V4\|636 | Bacteria | Proteobacteria | Alphaproteobacteria |
| 812 | B1.0\|REF99__V4\|2419 | Bacteria | Proteobacteria | Alphaproteobacteria |
| 813 | B1.0\|REF99__V4\|18804 | Bacteria | Proteobacteria | Alphaproteobacteria |
| 814 | B1.0\|REF99__V4\|1673 | Bacteria | Proteobacteria | Alphaproteobacteria |
| 815 | B1.0\|REF99__V4\|23912 | Bacteria | Proteobacteria | Alphaproteobacteria |
| 816 | B1.0\|REF99__V4\|21134 | Bacteria | Proteobacteria | Alphaproteobacteria |
| 817 | B1.0\|REF99__V4\|665 | Bacteria | Proteobacteria | Alphaproteobacteria |
| 818 | B1.0\|REF99__V4\|531 | Bacteria | Proteobacteria | Alphaproteobacteria |
| 819 | B1.0\|REF99__V4\|3592 | Bacteria | Proteobacteria | Alphaproteobacteria |
| 820 | B1.0\|REF99__V4\|16989 | Bacteria | Proteobacteria | Alphaproteobacteria |
| 821 | B1.0\|REF99__V4\|7892 | Bacteria | Proteobacteria | Alphaproteobacteria |
| 822 | B1.0\|REF99__V4\|6556 | Bacteria | Proteobacteria | Alphaproteobacteria |
| 823 | B1.0\|REF99__V4\|22177 | Bacteria | Proteobacteria | Alphaproteobacteria |
| 824 | B1.0\|REF99__V4\|211723 | Bacteria | Proteobacteria | Alphaproteobacteria |
| 825 | B1.0\|REF99__V4\|5606 | Bacteria | Proteobacteria | Alphaproteobacteria |
| 826 | B1.0\|REF99__V4\|467, B1.0\|REF97__V4\|467 | Bacteria | Proteobacteria | Alphaproteobacteria |
| 827 | B1.0\|REF99__V4\|91295 | Bacteria | Proteobacteria | Alphaproteobacteria |
| 828 | B1.0\|REF99__V4\|6971 | Bacteria | Proteobacteria | Alphaproteobacteria |
| 829 | B1.0\|REF99__V4\|289 | Bacteria | Proteobacteria | Alphaproteobacteria |
| 830 | B1.0\|REF99__V4\|19544 | Bacteria | Proteobacteria | Alphaproteobacteria |
| 831 | B1.0\|REF99__V4\|55385 | Bacteria | Proteobacteria | Alphaproteobacteria |
| 832 | B1.0\|REF99__V4\|28447 | Bacteria | Proteobacteria | Alphaproteobacteria |
| 833 | B1.0\|REF99__V4\|1358, B1.0\|REF97__V4\|1358 | Bacteria | Proteobacteria | Alphaproteobacteria |

TABLE 17-continued

Phylogeny and OTU designation of the endophytes useful for use in the present invention.

| | | | | |
|---|---|---|---|---|
| 834 | B1.0|REF99__V4|22405 | Bacteria | Proteobacteria | Alphaproteobacteria |
| 835 | B1.0|REF99__V4|12691 | Bacteria | Proteobacteria | Alphaproteobacteria |
| 836 | B1.0|REF99__V4|18288 | Bacteria | Proteobacteria | Alphaproteobacteria |
| 837 | B1.0|REF99__V4|720, B1.0|REF97__V4|720 | Bacteria | Proteobacteria | Alphaproteobacteria |
| 838 | B1.0|REF99__V4|3279, B1.0|REF97__V4|3279 | Bacteria | Proteobacteria | Alphaproteobacteria |
| 839 | B1.0|REF99__V4|1186 | Bacteria | Proteobacteria | Alphaproteobacteria |
| 840 | B1.0|REF99__V4|2925 | Bacteria | Proteobacteria | Alphaproteobacteria |
| 841 | B1.0|REF99__V4|719 | Bacteria | Proteobacteria | Alphaproteobacteria |
| 842 | B1.0|REF99__V4|27963 | Bacteria | Proteobacteria | Alphaproteobacteria |
| 843 | B1.0|REF99__V4|109275 | Bacteria | Proteobacteria | Alphaproteobacteria |
| 844 | B1.0|REF99__V4|18485 | Bacteria | Proteobacteria | Alphaproteobacteria |
| 845 | B1.0|REF99__V4|2959 | Bacteria | Proteobacteria | Alphaproteobacteria |
| 846 | B1.0|REF99__V4|9437 | Bacteria | Proteobacteria | Alphaproteobacteria |
| 847 | B1.0|REF99__V4|109284 | Bacteria | Proteobacteria | Alphaproteobacteria |
| 848 | B1.0|REF99__V4|32065 | Bacteria | Proteobacteria | Alphaproteobacteria |
| 849 | B1.0|REF99__V4|6952, B1.0|REF97__V4|6952 | Bacteria | Proteobacteria | Alphaproteobacteria |
| 850 | B1.0|REF99__V4|11157 | Bacteria | Proteobacteria | Alphaproteobacteria |
| 851 | B1.0|REF99__V4|13468 | Bacteria | Proteobacteria | Alphaproteobacteria |
| 852 | B1.0|REF99__V4|298 | Bacteria | Proteobacteria | Alphaproteobacteria |
| 853 | B1.0|REF99__V4|5965 | Bacteria | Proteobacteria | Alphaproteobacteria |
| 854 | B1.0|REF99__V4|68277 | Bacteria | Proteobacteria | Alphaproteobacteria |
| 855 | B1.0|REF99__V4|12068 | Bacteria | Proteobacteria | Alphaproteobacteria |
| 856 | B1.0|REF99__V4|2039 | Bacteria | Proteobacteria | Alphaproteobacteria |
| 857 | B1.0|REF99__V4|31960 | Bacteria | Proteobacteria | Alphaproteobacteria |
| 858 | B1.0|REF99__V4|17011 | Bacteria | Proteobacteria | Alphaproteobacteria |
| 859 | B1.0|REF99__V4|22570, B1.0|REF97__V4|22570 | Bacteria | Proteobacteria | Alphaproteobacteria |
| 860 | B1.0|REF99__V4|468 | Bacteria | Proteobacteria | Alphaproteobacteria |
| 861 | B1.0|REF99__V4|5005 | Bacteria | Proteobacteria | Alphaproteobacteria |
| 862 | B1.0|REF97__V4|144606 | Bacteria | Proteobacteria | Alphaproteobacteria |
| 863 | B1.0|REF99__V4|3618 | Bacteria | Proteobacteria | Betaproteobacteria |
| 864 | B1.0|REF99__V4|217 | Bacteria | Proteobacteria | Betaproteobacteria |
| 865 | B1.0|REF99__V4|9100 | Bacteria | Proteobacteria | Betaproteobacteria |
| 866 | B1.0|REF99__V4|3201 | Bacteria | Proteobacteria | Betaproteobacteria |
| 867 | B1.0|REF99__V4|124 | Bacteria | Proteobacteria | Betaproteobacteria |
| 868 | B1.0|REF99__V4|15539, B1.0|REF97__V4|15539 | Bacteria | Proteobacteria | Betaproteobacteria |
| 869 | B1.0|REF99__V4|199402 | Bacteria | Proteobacteria | Betaproteobacteria |
| 870 | B1.0|REF99__V4|5106 | Bacteria | Proteobacteria | Betaproteobacteria |
| 871 | B1.0|REF99__V4|6158 | Bacteria | Proteobacteria | Betaproteobacteria |
| 872 | B1.0|REF99__V4|15843 | Bacteria | Proteobacteria | Betaproteobacteria |
| 873 | B1.0|REF99__V4|186410 | Bacteria | Proteobacteria | Betaproteobacteria |
| 874 | B1.0|REF99__V4|23482 | Bacteria | Proteobacteria | Betaproteobacteria |
| 875 | B1.0|REF99__V4|2886 | Bacteria | Proteobacteria | Betaproteobacteria |
| 876 | B1.0|REF99__V4|24191 | Bacteria | Proteobacteria | Betaproteobacteria |
| 877 | B1.0|REF99__V4|7783 | Bacteria | Proteobacteria | Betaproteobacteria |
| 878 | B1.0|REF99__V4|245 | Bacteria | Proteobacteria | Betaproteobacteria |
| 879 | B1.0|REF99__V4|1349 | Bacteria | Proteobacteria | Betaproteobacteria |
| 880 | B1.0|REF99__V4|472, B1.0|REF97__V4|472 | Bacteria | Proteobacteria | Betaproteobacteria |
| 881 | B1.0|REF99__V4|434, B1.0|REF97__V4|434 | Bacteria | Proteobacteria | Betaproteobacteria |
| 882 | B1.0|REF99__V4|156328 | Bacteria | Proteobacteria | Betaproteobacteria |
| 883 | B1.0|REF99__V4|287 | Bacteria | Proteobacteria | Betaproteobacteria |
| 884 | B1.0|REF99__V4|1164 | Bacteria | Proteobacteria | Betaproteobacteria |
| 885 | B1.0|REF99__V4|261 | Bacteria | Proteobacteria | Betaproteobacteria |
| 886 | B1.0|REF99__V4|1287 | Bacteria | Proteobacteria | Betaproteobacteria |
| 887 | B1.0|REF99__V4|2238, B1.0|REF97__V4|2238 | Bacteria | Proteobacteria | Betaproteobacteria |
| 888 | B1.0|REF99__V4|556 | Bacteria | Proteobacteria | Betaproteobacteria |
| 889 | B1.0|REF99__V4|185, B1.0|REF97__V4|185 | Bacteria | Proteobacteria | Betaproteobacteria |
| 890 | B1.0|REF99__V4|811 | Bacteria | Proteobacteria | Betaproteobacteria |
| 891 | B1.0|REF97__V4|163430 | Bacteria | Proteobacteria | Betaproteobacteria |
| 892 | B1.0|REF99__V4|1177 | Bacteria | Proteobacteria | Betaproteobacteria |
| 893 | B1.0|REF99__V4|139 | Bacteria | Proteobacteria | Betaproteobacteria |
| 894 | B1.0|REF99__V4|828 | Bacteria | Proteobacteria | Betaproteobacteria |
| 895 | B1.0|REF99__V4|865 | Bacteria | Proteobacteria | Betaproteobacteria |
| 896 | B1.0|REF99__V4|7511 | Bacteria | Proteobacteria | Betaproteobacteria |
| 897 | B1.0|REF99__V4|8006 | Bacteria | Proteobacteria | Betaproteobacteria |
| 898 | B1.0|REF99__V4|20770 | Bacteria | Proteobacteria | Betaproteobacteria |
| 899 | B1.0|REF99__V4|23904 | Bacteria | Proteobacteria | Betaproteobacteria |
| 900 | B1.0|REF99__V4|44785 | Bacteria | Proteobacteria | Betaproteobacteria |
| 901 | B1.0|REF99__V4|2610 | Bacteria | Proteobacteria | Betaproteobacteria |
| 902 | B1.0|REF99__V4|4223 | Bacteria | Proteobacteria | Betaproteobacteria |

TABLE 17-continued

Phylogeny and OTU designation of the endophytes useful for use in the present invention.

| | | | | |
|---|---|---|---|---|
| 903 | B1.0|REF99__V4|4248 | Bacteria | Proteobacteria | Betaproteobacteria |
| 904 | B1.0|REF99__V4|2691 | Bacteria | Proteobacteria | Betaproteobacteria |
| 905 | B1.0|REF99__V4|66893 | Bacteria | Proteobacteria | Betaproteobacteria |
| 906 | B1.0|REF99__V4|132571 | Bacteria | Proteobacteria | Betaproteobacteria |
| 907 | B1.0|REF99__V4|4661 | Bacteria | Proteobacteria | Betaproteobacteria |
| 908 | B1.0|REF99__V4|9159 | Bacteria | Proteobacteria | Betaproteobacteria |
| 909 | B1.0|REF99__V4|18632 | Bacteria | Proteobacteria | Betaproteobacteria |
| 910 | B1.0|REF99__V4|2308 | Bacteria | Proteobacteria | Betaproteobacteria |
| 911 | B1.0|REF99__V4|716 | Bacteria | Proteobacteria | Betaproteobacteria |
| 912 | B1.0|REF99__V4|12337 | Bacteria | Proteobacteria | Betaproteobacteria |
| 913 | B1.0|REF99__V4|2416 | Bacteria | Proteobacteria | Betaproteobacteria |
| 914 | B1.0|REF99__V4|1626 | Bacteria | Proteobacteria | Betaproteobacteria |
| 915 | B1.0|REF99__V4|884 | Bacteria | Proteobacteria | Betaproteobacteria |
| 916 | B1.0|REF99__V4|3675, B1.0|REF97__V4|3675 | Bacteria | Proteobacteria | Betaproteobacteria |
| 917 | B1.0|REF99__V4|17224 | Bacteria | Proteobacteria | Betaproteobacteria |
| 918 | B1.0|REF99__V4|29789 | Bacteria | Proteobacteria | Betaproteobacteria |
| 919 | B1.0|REF99__V4|337 | Bacteria | Proteobacteria | Betaproteobacteria |
| 920 | B1.0|REF99__V4|5007 | Bacteria | Proteobacteria | Betaproteobacteria |
| 921 | B1.0|REF99__V4|599 | Bacteria | Proteobacteria | Betaproteobacteria |
| 922 | B1.0|REF99__V4|18254 | Bacteria | Proteobacteria | Betaproteobacteria |
| 923 | B1.0|REF99__V4|3116 | Bacteria | Proteobacteria | Betaproteobacteria |
| 924 | B1.0|REF99__V4|3285 | Bacteria | Proteobacteria | Betaproteobacteria |
| 925 | B1.0|REF99__V4|3688 | Bacteria | Proteobacteria | Betaproteobacteria |
| 926 | B1.0|REF99__V4|1185 | Bacteria | Proteobacteria | Betaproteobacteria |
| 927 | B1.0|REF99__V4|571 | Bacteria | Proteobacteria | Betaproteobacteria |
| 928 | B1.0|REF99__V4|1257 | Bacteria | Proteobacteria | Betaproteobacteria |
| 929 | B1.0|REF99__V4|876 | Bacteria | Proteobacteria | Betaproteobacteria |
| 930 | B1.0|REF97__V4|7729 | Bacteria | Proteobacteria | Betaproteobacteria |
| 931 | B1.0|REF99__V4|618 | Bacteria | Proteobacteria | Betaproteobacteria |
| 932 | B1.0|REF99__V4|5806 | Bacteria | Proteobacteria | Betaproteobacteria |
| 933 | B1.0|REF99__V4|3363 | Bacteria | Proteobacteria | Betaproteobacteria |
| 934 | B1.0|REF99__V4|1636 | Bacteria | Proteobacteria | Betaproteobacteria |
| 935 | B1.0|REF99__V4|381, B1.0|REF97__V4|381 | Bacteria | Proteobacteria | Betaproteobacteria |
| 936 | B1.0|REF99__V4|1587 | Bacteria | Proteobacteria | Betaproteobacteria |
| 937 | B1.0|REF99__V4|4399 | Bacteria | Proteobacteria | Betaproteobacteria |
| 938 | B1.0|REF99__V4|423 | Bacteria | Proteobacteria | Betaproteobacteria |
| 939 | B1.0|REF99__V4|1317 | Bacteria | Proteobacteria | Betaproteobacteria |
| 940 | B1.0|REF99__V4|2437 | Bacteria | Proteobacteria | Betaproteobacteria |
| 941 | B1.0|REF99__V4|121 | Bacteria | Proteobacteria | Betaproteobacteria |
| 942 | B1.0|REF99__V4|825 | Bacteria | Proteobacteria | Betaproteobacteria |
| 943 | B1.0|REF99__V4|26030 | Bacteria | Proteobacteria | Betaproteobacteria |
| 944 | B1.0|REF99__V4|101700 | Bacteria | Proteobacteria | Betaproteobacteria |
| 945 | B1.0|REF99__V4|442 | Bacteria | Proteobacteria | Betaproteobacteria |
| 946 | B1.0|REF99__V4|967 | Bacteria | Proteobacteria | Betaproteobacteria |
| 947 | B1.0|REF99__V4|699 | Bacteria | Proteobacteria | Betaproteobacteria |
| 948 | B1.0|REF99__V4|13028 | Bacteria | Proteobacteria | Betaproteobacteria |
| 949 | B1.0|REF99__V4|8693 | Bacteria | Proteobacteria | Betaproteobacteria |
| 950 | B1.0|REF99__V4|18044 | Bacteria | Proteobacteria | Betaproteobacteria |
| 951 | B1.0|REF99__V4|4643 | Bacteria | Proteobacteria | Betaproteobacteria |
| 952 | B1.0|REF99__V4|27324 | Bacteria | Proteobacteria | Betaproteobacteria |
| 953 | B1.0|REF99__V4|12728 | Bacteria | Proteobacteria | Betaproteobacteria |
| 954 | B1.0|REF99__V4|3344 | Bacteria | Proteobacteria | Betaproteobacteria |
| 955 | B1.0|REF97__V4|215659 | Bacteria | Proteobacteria | Betaproteobacteria |
| 956 | B1.0|REF97__V4|10239 | Bacteria | Proteobacteria | Betaproteobacteria |
| 957 | B1.0|REF99__V4|921, B1.0|REF97__V4|921 | Bacteria | Proteobacteria | Betaproteobacteria |
| 958 | B1.0|REF99__V4|4325 | Bacteria | Proteobacteria | Betaproteobacteria |
| 959 | B1.0|REF99__V4|126, B1.0|REF97__V4|126 | Bacteria | Proteobacteria | Betaproteobacteria |
| 960 | B1.0|REF99__V4|684 | Bacteria | Proteobacteria | Betaproteobacteria |
| 961 | B1.0|REF99__V4|3580 | Bacteria | Proteobacteria | Betaproteobacteria |
| 962 | B1.0|REF99__V4|102519 | Bacteria | Proteobacteria | Betaproteobacteria |
| 963 | B1.0|REF99__V4|33855 | Bacteria | Proteobacteria | Betaproteobacteria |
| 964 | B1.0|REF99__V4|1360 | Bacteria | Proteobacteria | Betaproteobacteria |
| 965 | B1.0|REF97__V4|13046 | Bacteria | Proteobacteria | Betaproteobacteria |
| 966 | B1.0|REF99__V4|142667 | Bacteria | Proteobacteria | Betaproteobacteria |
| 967 | B1.0|REF99__V4|5760 | Bacteria | Proteobacteria | Betaproteobacteria |
| 968 | B1.0|REF99__V4|972 | Bacteria | Proteobacteria | Betaproteobacteria |
| 969 | B1.0|REF99__V4|111796 | Bacteria | Proteobacteria | Betaproteobacteria |
| 970 | B1.0|REF99__V4|214989 | Bacteria | Proteobacteria | Betaproteobacteria |
| 971 | B1.0|REF99__V4|936 | Bacteria | Proteobacteria | Betaproteobacteria |
| 972 | B1.0|REF99__V4|218 | Bacteria | Proteobacteria | Betaproteobacteria |
| 973 | B1.0|REF99__V4|3063, B1.0|REF97__V4|3063 | Bacteria | Proteobacteria | Betaproteobacteria |
| 974 | B1.0|REF99__V4|2831, B1.0|REF97__V4|2831 | Bacteria | Proteobacteria | Betaproteobacteria |

TABLE 17-continued

Phylogeny and OTU designation of the endophytes useful for use in the present invention.

| | | | | |
|---|---|---|---|---|
| 975 | B1.0|REF99__V4|78549 | Bacteria | Proteobacteria | Betaproteobacteria |
| 976 | B1.0|REF99__V4|216419 | Bacteria | Proteobacteria | Betaproteobacteria |
| 977 | B1.0|REF99__V4|11337 | Bacteria | Proteobacteria | Betaproteobacteria |
| 978 | B1.0|REF99__V4|2438 | Bacteria | Proteobacteria | Betaproteobacteria |
| 979 | B1.0|REF99__V4|1141 | Bacteria | Proteobacteria | Betaproteobacteria |
| 980 | B1.0|REF99__V4|3913 | Bacteria | Proteobacteria | Betaproteobacteria |
| 981 | B1.0|REF99__V4|4421 | Bacteria | Proteobacteria | Betaproteobacteria |
| 982 | B1.0|REF99__V4|118, B1.0|REF97__V4|118 | Bacteria | Proteobacteria | Betaproteobacteria |
| 983 | B1.0|REF99__V4|9905 | Bacteria | Proteobacteria | Betaproteobacteria |
| 984 | B1.0|REF99__V4|233082 | Bacteria | Proteobacteria | Betaproteobacteria |
| 985 | B1.0|REF99__V4|11000 | Bacteria | Proteobacteria | Betaproteobacteria |
| 986 | B1.0|REF99__V4|4858 | Bacteria | Proteobacteria | Betaproteobacteria |
| 987 | B1.0|REF99__V4|16846 | Bacteria | Proteobacteria | Betaproteobacteria |
| 988 | B1.0|REF99__V4|18083 | Bacteria | Proteobacteria | Betaproteobacteria |
| 989 | B1.0|REF99__V4|3120 | Bacteria | Proteobacteria | Betaproteobacteria |
| 990 | B1.0|REF99__V4|317 | Bacteria | Proteobacteria | Betaproteobacteria |
| 991 | B1.0|REF99__V4|1682 | Bacteria | Proteobacteria | Betaproteobacteria |
| 992 | B1.0|REF99__V4|1615, B1.0|REF97__V4|1615 | Bacteria | Proteobacteria | Betaproteobacteria |
| 993 | B1.0|REF99__V4|21299 | Bacteria | Proteobacteria | Betaproteobacteria |
| 994 | B1.0|REF99__V4|8340 | Bacteria | Proteobacteria | Betaproteobacteria |
| 995 | B1.0|REF99__V4|1662 | Bacteria | Proteobacteria | Betaproteobacteria |
| 996 | B1.0|REF99__V4|13043 | Bacteria | Proteobacteria | Betaproteobacteria |
| 997 | B1.0|REF99__V4|3231 | Bacteria | Proteobacteria | Betaproteobacteria |
| 998 | B1.0|REF99__V4|22579 | Bacteria | Proteobacteria | Betaproteobacteria |
| 999 | B1.0|REF99__V4|6682 | Bacteria | Proteobacteria | Betaproteobacteria |
| 1000 | B1.0|REF99__V4|47241, B1.0|REF97__V4|47241 | Bacteria | Proteobacteria | Betaproteobacteria |
| 1001 | B1.0|REF99__V4|1646, B1.0|REF97__V4|1646 | Bacteria | Proteobacteria | Betaproteobacteria |
| 1002 | B1.0|REF99__V4|35832 | Bacteria | Proteobacteria | Betaproteobacteria |
| 1003 | B1.0|REF99__V4|502 | Bacteria | Proteobacteria | Betaproteobacteria |
| 1004 | B1.0|REF99__V4|1778 | Bacteria | Proteobacteria | Betaproteobacteria |
| 1005 | B1.0|REF99__V4|598 | Bacteria | Proteobacteria | Betaproteobacteria |
| 1006 | B1.0|REF99__V4|1100 | Bacteria | Proteobacteria | Betaproteobacteria |
| 1007 | B1.0|REF99__V4|9526, B1.0|REF97__V4|9526 | Bacteria | Proteobacteria | Betaproteobacteria |
| 1008 | B1.0|REF99__V4|5041 | Bacteria | Proteobacteria | Betaproteobacteria |
| 1009 | B1.0|REF99__V4|611, B1.0|REF97__V4|611 | Bacteria | Proteobacteria | Betaproteobacteria |
| 1010 | B1.0|REF97__V4|7846 | Bacteria | Proteobacteria | Betaproteobacteria |
| 1011 | B1.0|REF99__V4|2104, B1.0|REF97__V4|2104 | Bacteria | Proteobacteria | Betaproteobacteria |
| 1012 | B1.0|REF99__V4|597, B1.0|REF97__V4|597 | Bacteria | Proteobacteria | Betaproteobacteria |
| 1013 | B1.0|REF99__V4|13951 | Bacteria | Proteobacteria | Betaproteobacteria |
| 1014 | B1.0|REF99__V4|2317 | Bacteria | Proteobacteria | Betaproteobacteria |
| 1015 | B1.0|REF99__V4|20871, B1.0|REF97__V4|20871 | Bacteria | Proteobacteria | Betaproteobacteria |
| 1016 | B1.0|REF99__V4|30602, B1.0|REF97__V4|30602 | Bacteria | Proteobacteria | Betaproteobacteria |
| 1017 | B1.0|REF99__V4|1844 | Bacteria | Proteobacteria | Betaproteobacteria |
| 1018 | B1.0|REF99__V4|7652, B1.0|REF97__V4|7652 | Bacteria | Proteobacteria | Betaproteobacteria |
| 1019 | B1.0|REF97__V4|109630 | Bacteria | Proteobacteria | Betaproteobacteria |
| 1020 | B1.0|REF99__V4|180769 | Bacteria | Proteobacteria | Betaproteobacteria |
| 1021 | B1.0|REF99__V4|11738, B1.0|REF97__V4|11738 | Bacteria | Proteobacteria | Betaproteobacteria |
| 1022 | B1.0|REF99__V4|228544 | Bacteria | Proteobacteria | Betaproteobacteria |
| 1023 | B1.0|REF99__V4|140506 | Bacteria | Proteobacteria | Betaproteobacteria |
| 1024 | B1.0|REF99__V4|4882 | Bacteria | Proteobacteria | Betaproteobacteria |
| 1025 | B1.0|REF99__V4|79259 | Bacteria | Proteobacteria | Betaproteobacteria |
| 1026 | B1.0|REF99__V4|4473 | Bacteria | Proteobacteria | Betaproteobacteria |
| 1027 | B1.0|REF99__V4|13446 | Bacteria | Proteobacteria | Betaproteobacteria |
| 1028 | B1.0|REF99__V4|7861 | Bacteria | Proteobacteria | Betaproteobacteria |
| 1029 | B1.0|REF99__V4|2280 | Bacteria | Proteobacteria | Betaproteobacteria |
| 1030 | B1.0|REF99__V4|74427 | Bacteria | Proteobacteria | Betaproteobacteria |
| 1031 | B1.0|REF99__V4|21956 | Bacteria | Proteobacteria | Betaproteobacteria |
| 1032 | B1.0|REF99__V4|25510 | Bacteria | Proteobacteria | Betaproteobacteria |
| 1033 | B1.0|REF97__V4|52553 | Bacteria | Proteobacteria | Deltaproteobacteria |
| 1034 | B1.0|REF97__V4|120671 | Bacteria | Proteobacteria | Deltaproteobacteria |
| 1035 | B1.0|REF97__V4|15938 | Bacteria | Proteobacteria | Deltaproteobacteria |
| 1036 | B1.0|REF97__V4|222712 | Bacteria | Proteobacteria | Deltaproteobacteria |
| 1037 | B1.0|REF97__V4|42899 | Bacteria | Proteobacteria | Deltaproteobacteria |
| 1038 | B1.0|REF97__V4|105328 | Bacteria | Proteobacteria | Deltaproteobacteria |
| 1039 | B1.0|REF97__V4|127969 | Bacteria | Proteobacteria | Deltaproteobacteria |
| 1040 | B1.0|REF97__V4|214831 | Bacteria | Proteobacteria | Deltaproteobacteria |

TABLE 17-continued

Phylogeny and OTU designation of the endophytes useful for use in the present invention.

| | | | | |
|---|---|---|---|---|
| 1041 | B1.0\|REF99__V4\|109702 | Bacteria | Proteobacteria | Deltaproteobacteria |
| 1042 | B1.0\|REF99__V4\|6328 | Bacteria | Proteobacteria | Deltaproteobacteria |
| 1043 | B1.0\|REF99__V4\|6596 | Bacteria | Proteobacteria | Deltaproteobacteria |
| 1044 | B1.0\|REF97__V4\|67062 | Bacteria | Proteobacteria | Deltaproteobacteria |
| 1045 | B1.0\|REF99__V4\|54656 | Bacteria | Proteobacteria | Deltaproteobacteria |
| 1046 | B1.0\|REF99__V4\|25142 | Bacteria | Proteobacteria | Deltaproteobacteria |
| 1047 | B1.0\|REF99__V4\|4494 | Bacteria | Proteobacteria | Deltaproteobacteria |
| 1048 | B1.0\|REF99__V4\|79962 | Bacteria | Proteobacteria | Deltaproteobacteria |
| 1049 | B1.0\|REF97__V4\|14907 | Bacteria | Proteobacteria | Deltaproteobacteria |
| 1050 | B1.0\|REF97__V4\|20169 | Bacteria | Proteobacteria | Deltaproteobacteria |
| 1051 | B1.0\|REF97__V4\|9884 | Bacteria | Proteobacteria | Deltaproteobacteria |
| 1052 | B1.0\|REF99__V4\|26097 | Bacteria | Proteobacteria | Deltaproteobacteria |
| 1053 | B1.0\|REF97__V4\|539 | Bacteria | Proteobacteria | Deltaproteobacteria |
| 1054 | B1.0\|REF99__V4\|10347 | Bacteria | Proteobacteria | Deltaproteobacteria |
| 1055 | B1.0\|REF99__V4\|191731, B1.0\|REF97__V4\|191731 | Bacteria | Proteobacteria | Deltaproteobacteria |
| 1056 | B1.0\|REF99__V4\|71643 | Bacteria | Proteobacteria | Deltaproteobacteria |
| 1057 | B1.0\|REF99__V4\|69068 | Bacteria | Proteobacteria | Deltaproteobacteria |
| 1058 | B1.0\|REF99__V4\|23557, B1.0\|REF97__V4\|23557 | Bacteria | Proteobacteria | Deltaproteobacteria |
| 1059 | B1.0\|REF97__V4\|9758 | Bacteria | Proteobacteria | Deltaproteobacteria |
| 1060 | B1.0\|REF99__V4\|98244, B1.0\|REF97__V4\|98244 | Bacteria | Proteobacteria | Deltaproteobacteria |
| 1061 | B1.0\|REF97__V4\|34846 | Bacteria | Proteobacteria | Deltaproteobacteria |
| 1062 | B1.0\|REF99__V4\|20441 | Bacteria | Proteobacteria | Deltaproteobacteria |
| 1063 | B1.0\|REF99__V4\|66511 | Bacteria | Proteobacteria | Deltaproteobacteria |
| 1064 | B1.0\|REF97__V4\|153793 | Bacteria | Proteobacteria | Deltaproteobacteria |
| 1065 | B1.0\|REF99__V4\|91888 | Bacteria | Proteobacteria | Deltaproteobacteria |
| 1066 | B1.0\|REF97__V4\|164553 | Bacteria | Proteobacteria | Deltaproteobacteria |
| 1067 | B1.0\|REF99__V4\|36155, B1.0\|REF97__V4\|36155 | Bacteria | Proteobacteria | Deltaproteobacteria |
| 1068 | B1.0\|REF97__V4\|94957 | Bacteria | Proteobacteria | Deltaproteobacteria |
| 1069 | B1.0\|REF99__V4\|42971, B1.0\|REF97__V4\|42971 | Bacteria | Proteobacteria | Deltaproteobacteria |
| 1070 | B1.0\|REF99__V4\|112446, B1.0\|REF97__V4\|112446 | Bacteria | Proteobacteria | Deltaproteobacteria |
| 1071 | B1.0\|REF99__V4\|146984 | Bacteria | Proteobacteria | Deltaproteobacteria |
| 1072 | B1.0\|REF99__V4\|10089 | Bacteria | Proteobacteria | Deltaproteobacteria |
| 1073 | B1.0\|REF99__V4\|189342 | Bacteria | Proteobacteria | Deltaproteobacteria |
| 1074 | B1.0\|REF99__V4\|26212, B1.0\|REF97__V4\|26212 | Bacteria | Proteobacteria | Gammaproteobacteria |
| 1075 | B1.0\|REF99__V4\|156 | Bacteria | Proteobacteria | Gammaproteobacteria |
| 1076 | B1.0\|REF99__V4\|216503 | Bacteria | Proteobacteria | Gammaproteobacteria |
| 1077 | B1.0\|REF99__V4\|209, B1.0\|REF97__V4\|209 | Bacteria | Proteobacteria | Gammaproteobacteria |
| 1078 | B1.0\|REF99__V4\|69 | Bacteria | Proteobacteria | Gammaproteobacteria |
| 1079 | B1.0\|REF99__V4\|2152 | Bacteria | Proteobacteria | Gammaproteobacteria |
| 1080 | B1.0\|REF99__V4\|19 | Bacteria | Proteobacteria | Gammaproteobacteria |
| 1081 | B1.0\|REF99__V4\|156009 | Bacteria | Proteobacteria | Gammaproteobacteria |
| 1082 | B1.0\|REF99__V4\|6859, B1.0\|REF97__V4\|6859 | Bacteria | Proteobacteria | Gammaproteobacteria |
| 1083 | B1.0\|REF99__V4\|26074 | Bacteria | Proteobacteria | Gammaproteobacteria |
| 1084 | B1.0\|REF99__V4\|4602 | Bacteria | Proteobacteria | Gammaproteobacteria |
| 1085 | B1.0\|REF99__V4\|2 | Bacteria | Proteobacteria | Gammaproteobacteria |
| 1086 | B1.0\|REF99__V4\|25794 | Bacteria | Proteobacteria | Gammaproteobacteria |
| 1087 | B1.0\|REF99__V4\|199776 | Bacteria | Proteobacteria | Gammaproteobacteria |
| 1088 | B1.0\|REF99__V4\|1703 | Bacteria | Proteobacteria | Gammaproteobacteria |
| 1089 | B1.0\|REF99__V4\|127, B1.0\|REF97__V4\|127 | Bacteria | Proteobacteria | Gammaproteobacteria |
| 1090 | B1.0\|REF99__V4\|79117, B1.0\|REF97__V4\|79117 | Bacteria | Proteobacteria | Gammaproteobacteria |
| 1091 | B1.0\|REF99__V4\|15 | Bacteria | Proteobacteria | Gammaproteobacteria |
| 1092 | B1.0\|REF99__V4\|76 | Bacteria | Proteobacteria | Gammaproteobacteria |
| 1093 | B1.0\|REF99__V4\|29, B1.0\|REF97__V4\|29 | Bacteria | Proteobacteria | Gammaproteobacteria |
| 1094 | B1.0\|REF99__V4\|387 | Bacteria | Proteobacteria | Gammaproteobacteria |
| 1095 | B1.0\|REF99__V4\|54497 | Bacteria | Proteobacteria | Gammaproteobacteria |
| 1096 | B1.0\|REF99__V4\|35922 | Bacteria | Proteobacteria | Gammaproteobacteria |
| 1097 | B1.0\|REF99__V4\|159716 | Bacteria | Proteobacteria | Gammaproteobacteria |
| 1098 | B1.0\|REF99__V4\|171, B1.0\|REF97__V4\|171 | Bacteria | Proteobacteria | Gammaproteobacteria |
| 1099 | B1.0\|REF99__V4\|11708 | Bacteria | Proteobacteria | Gammaproteobacteria |
| 1100 | B1.0\|REF99__V4\|942 | Bacteria | Proteobacteria | Gammaproteobacteria |
| 1101 | B1.0\|REF99__V4\|424 | Bacteria | Proteobacteria | Gammaproteobacteria |
| 1102 | B1.0\|REF99__V4\|45 | Bacteria | Proteobacteria | Gammaproteobacteria |
| 1103 | B1.0\|REF99__V4\|51 | Bacteria | Proteobacteria | Gammaproteobacteria |
| 1104 | B1.0\|REF99__V4\|122519 | Bacteria | Proteobacteria | Gammaproteobacteria |
| 1105 | B1.0\|REF99__V4\|4080 | Bacteria | Proteobacteria | Gammaproteobacteria |

TABLE 17-continued

Phylogeny and OTU designation of the endophytes useful for use in the present invention.

| | | | | |
|---|---|---|---|---|
| 1106 | B1.0|REF99__V4|66, B1.0|REF97__V4|66 | Bacteria | Proteobacteria | Gammaproteobacteria |
| 1107 | B1.0|REF99__V4|1053 | Bacteria | Proteobacteria | Gammaproteobacteria |
| 1108 | B1.0|REF99__V4|1, B1.0|REF97__V4|1 | Bacteria | Proteobacteria | Gammaproteobacteria |
| 1109 | B1.0|REF99__V4|25629 | Bacteria | Proteobacteria | Gammaproteobacteria |
| 1110 | B1.0|REF99__V4|108549 | Bacteria | Proteobacteria | Gammaproteobacteria |
| 1111 | B1.0|REF99__V4|32282 | Bacteria | Proteobacteria | Gammaproteobacteria |
| 1112 | B1.0|REF99__V4|14460 | Bacteria | Proteobacteria | Gammaproteobacteria |
| 1113 | B1.0|REF99__V4|52497 | Bacteria | Proteobacteria | Gammaproteobacteria |
| 1114 | B1.0|REF97__V4|63136 | Bacteria | Proteobacteria | Gammaproteobacteria |
| 1115 | B1.0|REF97__V4|179769 | Bacteria | Proteobacteria | Gammaproteobacteria |
| 1116 | B1.0|REF97__V4|42898 | Bacteria | Proteobacteria | Gammaproteobacteria |
| 1117 | B1.0|REF97__V4|125730 | Bacteria | Proteobacteria | Gammaproteobacteria |
| 1118 | B1.0|REF97__V4|43380 | Bacteria | Proteobacteria | Gammaproteobacteria |
| 1119 | B1.0|SYM97__V4|489 | Bacteria | Proteobacteria | Gammaproteobacteria |
| 1120 | B1.0|REF97__V4|234264 | Bacteria | Proteobacteria | Gammaproteobacteria |
| 1121 | B1.0|REF97__V4|235417 | Bacteria | Proteobacteria | Gammaproteobacteria |
| 1122 | B1.0|SYM97__V4|604 | Bacteria | Proteobacteria | Gammaproteobacteria |
| 1123 | B1.0|REF97__V4|125590 | Bacteria | Proteobacteria | Gammaproteobacteria |
| 1124 | B1.0|REF99__V4|91426, B1.0|REF97__V4|91426 | Bacteria | Proteobacteria | Gammaproteobacteria |
| 1125 | B1.0|REF99__V4|234156, B1.0|REF97__V4|234156 | Bacteria | Proteobacteria | Gammaproteobacteria |
| 1126 | B1.0|REF97__V4|181338 | Bacteria | Proteobacteria | Gammaproteobacteria |
| 1127 | B1.0|REF97__V4|28158 | Bacteria | Proteobacteria | Gammaproteobacteria |
| 1128 | B1.0|REF97__V4|37028 | Bacteria | Proteobacteria | Gammaproteobacteria |
| 1129 | B1.0|REF97__V4|236567 | Bacteria | Proteobacteria | Gammaproteobacteria |
| 1130 | B1.0|REF99__V4|165865 | Bacteria | Proteobacteria | Gammaproteobacteria |
| 1131 | B1.0|REF97__V4|79926 | Bacteria | Proteobacteria | Gammaproteobacteria |
| 1132 | B1.0|REF97__V4|67182 | Bacteria | Proteobacteria | Gammaproteobacteria |
| 1133 | B1.0|REF97__V4|44508 | Bacteria | Proteobacteria | Gammaproteobacteria |
| 1134 | B1.0|REF99__V4|986 | Bacteria | Proteobacteria | Gammaproteobacteria |
| 1135 | B1.0|REF97__V4|190862 | Bacteria | Proteobacteria | Gammaproteobacteria |
| 1136 | B1.0|REF99__V4|162940 | Bacteria | Proteobacteria | Gammaproteobacteria |
| 1137 | B1.0|REF97__V4|83527 | Bacteria | Proteobacteria | Gammaproteobacteria |
| 1138 | B1.0|REF99__V4|120699, B1.0|REF97__V4|120699 | Bacteria | Proteobacteria | Gammaproteobacteria |
| 1139 | B1.0|REF99__V4|353 | Bacteria | Proteobacteria | Gammaproteobacteria |
| 1140 | B1.0|REF99__V4|268 | Bacteria | Proteobacteria | Gammaproteobacteria |
| 1141 | B1.0|REF99__V4|20729 | Bacteria | Proteobacteria | Gammaproteobacteria |
| 1142 | B1.0|REF99__V4|1129 | Bacteria | Proteobacteria | Gammaproteobacteria |
| 1143 | B1.0|REF99__V4|31 | Bacteria | Proteobacteria | Gammaproteobacteria |
| 1144 | B1.0|REF99__V4|2074 | Bacteria | Proteobacteria | Gammaproteobacteria |
| 1145 | B1.0|REF99__V4|78035 | Bacteria | Proteobacteria | Gammaproteobacteria |
| 1146 | B1.0|REF99__V4|101 | Bacteria | Proteobacteria | Gammaproteobacteria |
| 1147 | B1.0|REF99__V4|145 | Bacteria | Proteobacteria | Gammaproteobacteria |
| 1148 | B1.0|REF99__V4|1501 | Bacteria | Proteobacteria | Gammaproteobacteria |
| 1149 | B1.0|REF99__V4|83674 | Bacteria | Proteobacteria | Gammaproteobacteria |
| 1150 | B1.0|REF99__V4|733 | Bacteria | Proteobacteria | Gammaproteobacteria |
| 1151 | B1.0|REF99__V4|1740 | Bacteria | Proteobacteria | Gammaproteobacteria |
| 1152 | B1.0|REF99__V4|141 | Bacteria | Proteobacteria | Gammaproteobacteria |
| 1153 | B1.0|REF99__V4|490 | Bacteria | Proteobacteria | Gammaproteobacteria |
| 1154 | B1.0|REF99__V4|105366, B1.0|REF97__V4|105366 | Bacteria | Proteobacteria | Gammaproteobacteria |
| 1155 | B1.0|REF99__V4|87918 | Bacteria | Proteobacteria | Gammaproteobacteria |
| 1156 | B1.0|REF99__V4|32 | Bacteria | Proteobacteria | Gammaproteobacteria |
| 1157 | B1.0|REF99__V4|194 | Bacteria | Proteobacteria | Gammaproteobacteria |
| 1158 | B1.0|REF99__V4|1323, B1.0|REF97__V4|1323 | Bacteria | Proteobacteria | Gammaproteobacteria |
| 1159 | B1.0|REF99__V4|138, B1.0|REF97__V4|138 | Bacteria | Proteobacteria | Gammaproteobacteria |
| 1160 | B1.0|REF99__V4|133557 | Bacteria | Proteobacteria | Gammaproteobacteria |
| 1161 | B1.0|REF97__V4|26173 | Bacteria | Proteobacteria | Gammaproteobacteria |
| 1162 | B1.0|REF97__V4|66750 | Bacteria | Proteobacteria | Gammaproteobacteria |
| 1163 | B1.0|REF99__V4|6806, B1.0|REF97__V4|6806 | Bacteria | Proteobacteria | Gammaproteobacteria |
| 1164 | B1.0|REF99__V4|24830 | Bacteria | Proteobacteria | Gammaproteobacteria |
| 1165 | B1.0|REF99__V4|170 | Bacteria | Proteobacteria | Gammaproteobacteria |
| 1166 | B1.0|REF99__V4|142 | Bacteria | Proteobacteria | Gammaproteobacteria |
| 1167 | B1.0|REF99__V4|33 | Bacteria | Proteobacteria | Gammaproteobacteria |
| 1168 | B1.0|REF97__V4|31209 | Bacteria | Proteobacteria | Gammaproteobacteria |
| 1169 | B1.0|REF99__V4|525 | Bacteria | Proteobacteria | Gammaproteobacteria |
| 1170 | B1.0|REF99__V4|144828, B1.0|REF97__V4|144828 | Bacteria | Proteobacteria | Gammaproteobacteria |
| 1171 | B1.0|REF99__V4|1639, B1.0|REF97__V4|1639 | Bacteria | Proteobacteria | Gammaproteobacteria |

TABLE 17-continued

Phylogeny and OTU designation of the endophytes useful for use in the present invention.

| | | | | |
|---|---|---|---|---|
| 1172 | B1.0\|REF99__V4\|401 | Bacteria | Proteobacteria | Gammaproteobacteria |
| 1173 | B1.0\|REF99__V4\|216102 | Bacteria | Proteobacteria | Gammaproteobacteria |
| 1174 | B1.0\|SYM97__V4\|13 | Bacteria | Proteobacteria | Gammaproteobacteria |
| 1175 | B1.0\|REF99__V4\|284, B1.0\|REF97__V4\|284 | Bacteria | Proteobacteria | Gammaproteobacteria |
| 1176 | B1.0\|REF99__V4\|21817, B1.0\|REF97__V4\|21817 | Bacteria | Proteobacteria | Gammaproteobacteria |
| 1177 | B1.0\|REF99__V4\|64 | Bacteria | Proteobacteria | Gammaproteobacteria |
| 1178 | B1.0\|REF99__V4\|111054 | Bacteria | Proteobacteria | Gammaproteobacteria |
| 1179 | B1.0\|REF99__V4\|372 | Bacteria | Proteobacteria | Gammaproteobacteria |
| 1180 | B1.0\|REF99__V4\|166, B1.0\|REF97__V4\|166 | Bacteria | Proteobacteria | Gammaproteobacteria |
| 1181 | B1.0\|REF99__V4\|183 | Bacteria | Proteobacteria | Gammaproteobacteria |
| 1182 | B1.0\|REF99__V4\|33744, B1.0\|REF97__V4\|33744 | Bacteria | Proteobacteria | Gammaproteobacteria |
| 1183 | B1.0\|REF99__V4\|11474 | Bacteria | Proteobacteria | Gammaproteobacteria |
| 1184 | B1.0\|REF99__V4\|20510 | Bacteria | Proteobacteria | Gammaproteobacteria |
| 1185 | B1.0\|REF99__V4\|22 | Bacteria | Proteobacteria | Gammaproteobacteria |
| 1186 | B1.0\|REF99__V4\|81 | Bacteria | Proteobacteria | Gammaproteobacteria |
| 1187 | B1.0\|REF99__V4\|3083, B1.0\|REF97__V4\|3083 | Bacteria | Proteobacteria | Gammaproteobacteria |
| 1188 | B1.0\|REF99__V4\|150, B1.0\|REF97__V4\|150 | Bacteria | Proteobacteria | Gammaproteobacteria |
| 1189 | B1.0\|REF99__V4\|79 | Bacteria | Proteobacteria | Gammaproteobacteria |
| 1190 | B1.0\|REF99__V4\|129 | Bacteria | Proteobacteria | Gammaproteobacteria |
| 1191 | B1.0\|REF99__V4\|150716, B1.0\|REF97__V4\|150716 | Bacteria | Proteobacteria | Gammaproteobacteria |
| 1192 | B1.0\|REF99__V4\|94350 | Bacteria | Proteobacteria | Gammaproteobacteria |
| 1193 | B1.0\|REF99__V4\|2380 | Bacteria | Proteobacteria | Gammaproteobacteria |
| 1194 | B1.0\|REF99__V4\|82361, B1.0\|REF97__V4\|82361 | Bacteria | Proteobacteria | Gammaproteobacteria |
| 1195 | B1.0\|REF99__V4\|1916, B1.0\|REF97__V4\|1916 | Bacteria | Proteobacteria | Gammaproteobacteria |
| 1196 | B1.0\|REF99__V4\|67242, B1.0\|REF97__V4\|67242 | Bacteria | Proteobacteria | Gammaproteobacteria |
| 1197 | B1.0\|REF99__V4\|131 | Bacteria | Proteobacteria | Gammaproteobacteria |
| 1198 | B1.0\|REF99__V4\|201806 | Bacteria | Proteobacteria | Gammaproteobacteria |
| 1199 | B1.0\|REF99__V4\|589 | Bacteria | Proteobacteria | Gammaproteobacteria |
| 1200 | B1.0\|REF99__V4\|2362 | Bacteria | Proteobacteria | Gammaproteobacteria |
| 1201 | B1.0\|REF99__V4\|42 | Bacteria | Proteobacteria | Gammaproteobacteria |
| 1202 | B1.0\|REF99__V4\|2386 | Bacteria | Proteobacteria | Gammaproteobacteria |
| 1203 | B1.0\|REF99__V4\|1444 | Bacteria | Proteobacteria | Gammaproteobacteria |
| 1204 | B1.0\|REF97__V4\|63739 | Bacteria | Proteobacteria | Gammaproteobacteria |
| 1205 | B1.0\|REF97__V4\|197984 | Bacteria | Proteobacteria | Gammaproteobacteria |
| 1206 | B1.0\|REF97__V4\|219922 | Bacteria | Proteobacteria | Gammaproteobacteria |
| 1207 | B1.0\|REF97__V4\|30882 | Bacteria | Proteobacteria | Gammaproteobacteria |
| 1208 | B1.0\|REF97__V4\|790 | Bacteria | Proteobacteria | Gammaproteobacteria |
| 1209 | B1.0\|REF99__V4\|488 | Bacteria | Proteobacteria | Gammaproteobacteria |
| 1210 | B1.0\|REF99__V4\|5027 | Bacteria | Proteobacteria | Gammaproteobacteria |
| 1211 | B1.0\|REF99__V4\|11489 | Bacteria | Proteobacteria | Gammaproteobacteria |
| 1212 | B1.0\|REF99__V4\|269 | Bacteria | Proteobacteria | Gammaproteobacteria |
| 1213 | B1.0\|REF99__V4\|1759 | Bacteria | Proteobacteria | Gammaproteobacteria |
| 1214 | B1.0\|REF99__V4\|131938 | Bacteria | Proteobacteria | Gammaproteobacteria |
| 1215 | B1.0\|REF99__V4\|14182 | Bacteria | Proteobacteria | Gammaproteobacteria |
| 1216 | B1.0\|REF99__V4\|3442 | Bacteria | Proteobacteria | Gammaproteobacteria |
| 1217 | B1.0\|REF99__V4\|2052 | Bacteria | Proteobacteria | Gammaproteobacteria |
| 1218 | B1.0\|REF99__V4\|15340 | Bacteria | Proteobacteria | Gammaproteobacteria |
| 1219 | B1.0\|REF99__V4\|145821 | Bacteria | Proteobacteria | Gammaproteobacteria |
| 1220 | B1.0\|REF99__V4\|20595 | Bacteria | Proteobacteria | Gammaproteobacteria |
| 1221 | B1.0\|REF99__V4\|2512 | Bacteria | Proteobacteria | Gammaproteobacteria |
| 1222 | B1.0\|REF99__V4\|21436 | Bacteria | Proteobacteria | Gammaproteobacteria |
| 1223 | B1.0\|REF99__V4\|26208 | Bacteria | Proteobacteria | Gammaproteobacteria |
| 1224 | B1.0\|REF99__V4\|21700, B1.0\|REF97__V4\|21700 | Bacteria | Proteobacteria | Gammaproteobacteria |
| 1225 | B1.0\|REF99__V4\|2167 | Bacteria | Proteobacteria | Gammaproteobacteria |
| 1226 | B1.0\|REF99__V4\|4402 | Bacteria | Proteobacteria | Gammaproteobacteria |
| 1227 | B1.0\|REF99__V4\|196900, B1.0\|REF97__V4\|196900 | Bacteria | Proteobacteria | Gammaproteobacteria |
| 1228 | B1.0\|REF99__V4\|20816 | Bacteria | Proteobacteria | Gammaproteobacteria |
| 1229 | B1.0\|REF99__V4\|1866 | Bacteria | Proteobacteria | Gammaproteobacteria |
| 1230 | B1.0\|REF99__V4\|1328 | Bacteria | Proteobacteria | Gammaproteobacteria |
| 1231 | B1.0\|REF99__V4\|2217, B1.0\|REF97__V4\|2217 | Bacteria | Proteobacteria | Gammaproteobacteria |
| 1232 | B1.0\|REF99__V4\|5006 | Bacteria | Proteobacteria | Gammaproteobacteria |
| 1233 | B1.0\|REF99__V4\|6975 | Bacteria | Proteobacteria | Gammaproteobacteria |
| 1234 | B1.0\|REF99__V4\|4256 | Bacteria | Proteobacteria | Gammaproteobacteria |
| 1235 | B1.0\|REF99__V4\|1714 | Bacteria | Proteobacteria | Gammaproteobacteria |
| 1236 | B1.0\|REF99__V4\|24823 | Bacteria | Proteobacteria | Gammaproteobacteria |

TABLE 17-continued

Phylogeny and OTU designation of the endophytes useful for use in the present invention.

| | | | | |
|---|---|---|---|---|
| 1237 | B1.0|REF99__V4|97391 | Bacteria | Proteobacteria | Gammaproteobacteria |
| 1238 | B1.0|REF99__V4|2354 | Bacteria | Proteobacteria | Gammaproteobacteria |
| 1239 | B1.0|REF99__V4|11632 | Bacteria | Proteobacteria | Gammaproteobacteria |
| 1240 | B1.0|REF99__V4|2458 | Bacteria | Proteobacteria | Gammaproteobacteria |
| 1241 | B1.0|REF99__V4|511 | Bacteria | Proteobacteria | Gammaproteobacteria |
| 1242 | B1.0|REF99__V4|6796 | Bacteria | Proteobacteria | Gammaproteobacteria |
| 1243 | B1.0|REF99__V4|107947 | Bacteria | Proteobacteria | Gammaproteobacteria |
| 1244 | B1.0|REF99__V4|1372 | Bacteria | Proteobacteria | Gammaproteobacteria |
| 1245 | B1.0|REF99__V4|12375, B1.0|REF97__V4|12375 | Bacteria | Proteobacteria | Gammaproteobacteria |
| 1246 | B1.0|REF99__V4|7033 | Bacteria | Proteobacteria | Gammaproteobacteria |
| 1247 | B1.0|REF99__V4|137821 | Bacteria | Proteobacteria | Gammaproteobacteria |
| 1248 | B1.0|REF99__V4|1792 | Bacteria | Proteobacteria | Gammaproteobacteria |
| 1249 | B1.0|REF99__V4|9575, B1.0|REF97__V4|9575 | Bacteria | Proteobacteria | Gammaproteobacteria |
| 1250 | B1.0|REF99__V4|9902, B1.0|REF97__V4|9902 | Bacteria | Proteobacteria | Gammaproteobacteria |
| 1251 | B1.0|REF99__V4|6537 | Bacteria | Proteobacteria | Gammaproteobacteria |
| 1252 | B1.0|REF99__V4|160212 | Bacteria | Proteobacteria | Gammaproteobacteria |
| 1253 | B1.0|REF99__V4|120551 | Bacteria | Proteobacteria | Gammaproteobacteria |
| 1254 | B1.0|REF99__V4|4443 | Bacteria | Proteobacteria | Gammaproteobacteria |
| 1255 | B1.0|REF99__V4|55107 | Bacteria | Proteobacteria | Gammaproteobacteria |
| 1256 | B1.0|REF97__V4|67362 | Bacteria | Proteobacteria | Gammaproteobacteria |
| 1257 | B1.0|REF99__V4|5320 | Bacteria | Proteobacteria | Gammaproteobacteria |
| 1258 | B1.0|REF99__V4|8092 | Bacteria | Proteobacteria | Gammaproteobacteria |
| 1259 | B1.0|REF99__V4|23691 | Bacteria | Proteobacteria | Gammaproteobacteria |
| 1260 | B1.0|REF99__V4|19598 | Bacteria | Proteobacteria | Gammaproteobacteria |
| 1261 | B1.0|REF99__V4|69571 | Bacteria | Spirochaetae | Spirochaetes |
| 1262 | B1.0|SYM97__V4|559 | Bacteria | Tenericutes | Mollicutes |
| 1263 | B1.0|REF99__V4|6175 | Bacteria | Tenericutes | Mollicutes |
| 1264 | B1.0|REF99__V4|26206 | Bacteria | Tenericutes | Mollicutes |
| 1265 | B1.0|REF99__V4|211907 | Bacteria | Tenericutes | Mollicutes |
| 1266 | B1.0|REF99__V4|121010, B1.0|REF97__V4|121010 | Bacteria | Tenericutes | Mollicutes |
| 1267 | B1.0|REF97__V4|102413 | Bacteria | Thermi | Deinococci |
| 1268 | B1.0|REF97__V4|152873 | Bacteria | TM6 | SJA-4 |
| 1269 | B1.0|REF97__V4|49212 | Bacteria | TM6 | SJA-4 |
| 1270 | B1.0|REF97__V4|198082 | Bacteria | TM6 | SJA-4 |
| 1271 | B1.0|REF97__V4|143473 | Bacteria | TM6 | SJA-4 |
| 1272 | B1.0|REF97__V4|44128 | Bacteria | TM6 | SJA-4 |
| 1273 | B1.0|REF97__V4|192323 | Bacteria | TM6 | SJA-4 |
| 1274 | B1.0|REF99__V4|131847 | Bacteria | TM6 | |
| 1275 | B1.0|REF99__V4|31055 | Bacteria | Verrucomicrobia | OPB35__soil__group |
| 1276 | B1.0|REF99__V4|166117 | Bacteria | Verrucomicrobia | OPB35__soil__group |
| 1277 | B1.0|REF97__V4|120459 | Bacteria | Verrucomicrobia | OPB35__soil__group |
| 1278 | B1.0|REF99__V4|15795 | Bacteria | Verrucomicrobia | OPB35__soil__group |
| 1279 | B1.0|REF99__V4|121096 | Bacteria | Verrucomicrobia | OPB35__soil__group |
| 1280 | B1.0|REF97__V4|29687 | Bacteria | Verrucomicrobia | OPB35__soil__group |
| 1281 | B1.0|REF99__V4|7329, B1.0|REF97__V4|7329 | Bacteria | Verrucomicrobia | OPB35__soil__group |
| 1282 | B1.0|REF99__V4|92779 | Bacteria | Verrucomicrobia | OPB35__soil__group |
| 1283 | B1.0|REF99__V4|191231 | Bacteria | Verrucomicrobia | OPB35__soil__group |
| 1284 | B1.0|REF97__V4|80096 | Bacteria | Verrucomicrobia | OPB35__soil__group |
| 1285 | B1.0|REF99__V4|55354 | Bacteria | Verrucomicrobia | OPB35__soil__group |
| 1286 | B1.0|REF97__V4|79639 | Bacteria | Verrucomicrobia | Opitutae |
| 1287 | B1.0|REF99__V4|181275 | Bacteria | Verrucomicrobia | Opitutae |
| 1288 | B1.0|REF97__V4|93209 | Bacteria | Verrucomicrobia | Opitutae |
| 1289 | B1.0|REF99__V4|82934, B1.0|REF97__V4|82934 | Bacteria | Verrucomicrobia | Opitutae |
| 1290 | B1.0|REF97__V4|91237 | Bacteria | Verrucomicrobia | Opitutae |
| 1291 | B1.0|REF99__V4|214952 | Bacteria | Verrucomicrobia | Opitutae |
| 1292 | B1.0|REF99__V4|120715, B1.0|REF97__V4|120715 | Bacteria | Verrucomicrobia | Opitutae |
| 1293 | B1.0|REF97__V4|78747 | Bacteria | Verrucomicrobia | Opitutae |
| 1294 | B1.0|REF99__V4|180969, B1.0|REF97__V4|180969 | Bacteria | Verrucomicrobia | Opitutae |
| 1295 | B1.0|REF97__V4|17836 | Bacteria | Verrucomicrobia | Opitutae |
| 1296 | B1.0|REF99__V4|13061, B1.0|REF97__V4|13061 | Bacteria | Verrucomicrobia | Opitutae |
| 1297 | B1.0|REF99__V4|216000 | Bacteria | Verrucomicrobia | Opitutae |
| 1298 | B1.0|REF97__V4|237400 | Bacteria | Verrucomicrobia | Pedosphaerae |
| 1299 | B1.0|REF97__V4|136223 | Bacteria | Verrucomicrobia | Spartobacteria |
| 1300 | B1.0|REF97__V4|218175 | Bacteria | Verrucomicrobia | Spartobacteria |
| 1301 | B1.0|REF99__V4|80189 | Bacteria | Verrucomicrobia | Spartobacteria |
| 1302 | B1.0|REF97__V4|81008 | Bacteria | Verrucomicrobia | Spartobacteria |
| 1303 | B1.0|REF97__V4|55981 | Bacteria | Verrucomicrobia | Spartobacteria |
| 1304 | B1.0|REF97__V4|88941 | Bacteria | Verrucomicrobia | Spartobacteria |
| 1305 | B1.0|REF99__V4|36311 | Bacteria | Verrucomicrobia | Spartobacteria |

TABLE 17-continued

Phylogeny and OTU designation of the endophytes useful for use in the present invention.

| | | | | |
|---|---|---|---|---|
| 1306 | B1.0|REF97__V4|6199 | Bacteria | Verrucomicrobia | Spartobacteria |
| 1307 | B1.0|REF99__V4|1227 | Bacteria | Verrucomicrobia | Spartobacteria |
| 1308 | B1.0|REF99__V4|2156 | Bacteria | Verrucomicrobia | Spartobacteria |
| 1309 | B1.0|REF99__V4|18461 | Bacteria | Verrucomicrobia | Spartobacteria |
| 1310 | B1.0|REF97__V4|21427 | Bacteria | Verrucomicrobia | Verrucomicrobiae |
| 1311 | B1.0|REF97__V4|219724 | Bacteria | Verrucomicrobia | Verrucomicrobiae |
| 1312 | B1.0|REF97__V4|3185 | Bacteria | Verrucomicrobia | Verrucomicrobiae |
| 1313 | B1.0|REF99__V4|74316 | Bacteria | Verrucomicrobia | Verrucomicrobiae |
| 1314 | B1.0|REF99__V4|21410, B1.0|REF97__V4|21410 | Bacteria | Verrucomicrobia | Verrucomicrobiae |
| 1315 | B1.0|REF99__V4|21571 | Bacteria | Verrucomicrobia | Verrucomicrobiae |
| 1316 | B1.0|REF99__V4|214923 | Bacteria | Verrucomicrobia | Verrucomicrobiae |
| 1317 | B1.0|REF99__V4|217302 | Bacteria | Verrucomicrobia | Verrucomicrobiae |
| 1318 | B1.0|REF99__V4|3654 | Bacteria | Verrucomicrobia | Verrucomicrobiae |
| 1319 | B1.0|SYM97__V4|334 | Bacteria | | |
| 1320 | B1.0|SYM97__V4|532 | Bacteria | | |
| 1321 | B1.0|SYM97__V4|29 | Bacteria | | |
| 1322 | B1.0|SYM97__V4|670 | Bacteria | | |
| 1323 | B1.0|SYM97__V4|802 | Bacteria | | |
| 1324 | B1.0|SYM97__V4|551 | Bacteria | | |
| 1325 | B1.0|SYM97__V4|382 | Bacteria | | |
| 1326 | B1.0|SYM97__V4|136 | Bacteria | | |
| 1327 | B1.0|SYM97__V4|940 | Bacteria | | |
| 1328 | B1.0|SYM97__V4|205 | Bacteria | | |
| 1329 | B1.0|SYM97__V4|110 | Bacteria | | |
| 1330 | B1.0|SYM97__V4|227 | Bacteria | | |
| 1331 | B1.0|SYM97__V4|713 | Bacteria | | |
| 1332 | B1.0|SYM97__V4|306 | Bacteria | | |
| 1333 | B1.0|SYM97__V4|817 | Bacteria | | |
| 1334 | B1.0|SYM97__V4|152 | Bacteria | | |
| 1335 | B1.0|SYM97__V4|145 | Bacteria | | |
| 1336 | B1.0|SYM97__V4|536 | Bacteria | | |
| 1337 | B1.0|SYM97__V4|733 | Bacteria | | |
| 1338 | B1.0|SYM97__V4|143 | Bacteria | | |
| 1339 | B1.0|SYM97__V4|734 | Bacteria | | |
| 1340 | B1.0|SYM97__V4|326 | Bacteria | | |
| 1341 | B1.0|SYM97__V4|1475 | Bacteria | | |
| 1342 | B1.0|SYM97__V4|381 | Bacteria | | |
| 1343 | B1.0|SYM97__V4|253 | Bacteria | | |
| 1344 | B1.0|SYM97__V4|132 | Bacteria | | |
| 1345 | B1.0|SYM97__V4|138 | Bacteria | | |
| 1346 | B1.0|SYM97__V4|349 | Bacteria | | |
| 1347 | B1.0|SYM97__V4|405 | Bacteria | | |
| 1348 | B1.0|SYM97__V4|191 | Bacteria | | |
| 1349 | B1.0|SYM97__V4|724 | Bacteria | | |
| 1350 | B1.0|SYM97__V4|325 | Bacteria | | |
| 1351 | B1.0|SYM97__V4|509 | Bacteria | | |
| 1352 | B1.0|SYM97__V4|155 | Bacteria | | |
| 1353 | B1.0|SYM97__V4|440 | Bacteria | | |
| 1354 | B1.0|SYM97__V4|103 | Bacteria | | |
| 1355 | B1.0|SYM97__V4|250 | Bacteria | | |
| 1356 | B1.0|SYM97__V4|134 | Bacteria | | |
| 1357 | B1.0|SYM97__V4|276 | Bacteria | | |
| 1358 | B1.0|SYM97__V4|94 | Bacteria | | |
| 1359 | B1.0|SYM97__V4|894 | Bacteria | | |
| 1360 | B1.0|SYM97__V4|86 | Bacteria | | |
| 1361 | B1.0|SYM97__V4|154 | Bacteria | | |
| 1362 | B1.0|SYM97__V4|570 | Bacteria | | |
| 1363 | B1.0|SYM97__V4|703 | Bacteria | | |
| 1364 | B1.0|SYM97__V4|1396 | Bacteria | | |
| 1365 | B1.0|SYM97__V4|71 | Bacteria | | |
| 1366 | B1.0|SYM97__V4|417 | Bacteria | | |
| 1367 | B1.0|SYM97__V4|439 | Bacteria | | |
| 1368 | B1.0|SYM97__V4|392 | Bacteria | | |
| 1369 | B1.0|SYM97__V4|1397 | Bacteria | | |
| 1370 | B1.0|SYM97__V4|98 | Bacteria | | |
| 1371 | B1.0|SYM97__V4|421 | Bacteria | | |
| 1372 | B1.0|SYM97__V4|16 | Bacteria | | |
| 1373 | B1.0|SYM97__V4|43 | Bacteria | | |
| 1374 | B1.0|SYM97__V4|482 | Bacteria | | |
| 1375 | B1.0|SYM97__V4|42 | Bacteria | | |
| 1376 | B1.0|SYM97__V4|235 | Bacteria | | |
| 1377 | B1.0|SYM97__V4|656 | Bacteria | | |
| 1378 | B1.0|SYM97__V4|352 | Bacteria | | |
| 1379 | B1.0|SYM97__V4|241 | Bacteria | | |
| 1380 | B1.0|SYM97__V4|137 | Bacteria | | |
| 1381 | B1.0|REF97__V4|180 | Bacteria | | |
| 1382 | B1.0|SYM97__V4|243 | Bacteria | | |

TABLE 17-continued

Phylogeny and OTU designation of the endophytes useful for use in the present invention.

| | | |
|---|---|---|
| 1383 | B1.0|SYM97__V4|120 | Bacteria |
| 1384 | B1.0|SYM97__V4|336 | Bacteria |
| 1385 | B1.0|SYM97__V4|399 | Bacteria |
| 1386 | B1.0|SYM97__V4|1020 | Bacteria |
| 1387 | B1.0|SYM97__V4|490 | Bacteria |
| 1388 | B1.0|SYM97__V4|158 | Bacteria |
| 1389 | B1.0|SYM97__V4|592 | Bacteria |
| 1390 | B1.0|SYM97__V4|659 | Bacteria |
| 1391 | B1.0|SYM97__V4|401 | Bacteria |
| 1392 | B1.0|SYM97__V4|1402 | Bacteria |
| 1393 | B1.0|SYM97__V4|706 | Bacteria |
| 1394 | B1.0|SYM97__V4|384 | Bacteria |
| 1395 | B1.0|SYM97__V4|687 | Bacteria |
| 1396 | B1.0|SYM97__V4|124 | Bacteria |
| 1397 | B1.0|SYM97__V4|285 | Bacteria |
| 1398 | B1.0|SYM97__V4|371 | Bacteria |
| 1399 | B1.0|SYM97__V4|111 | Bacteria |
| 1400 | B1.0|SYM97__V4|477 | Bacteria |
| 1401 | B1.0|SYM97__V4|788 | Bacteria |
| 1402 | B1.0|SYM97__V4|644 | Bacteria |
| 1403 | B1.0|SYM97__V4|674 | Bacteria |
| 1404 | B1.0|SYM97__V4|480 | Bacteria |
| 1405 | B1.0|SYM97__V4|130 | Bacteria |
| 1406 | B1.0|SYM97__V4|353 | Bacteria |
| 1407 | B1.0|SYM97__V4|166 | Bacteria |
| 1408 | B1.0|SYM97__V4|1018 | Bacteria |
| 1409 | B1.0|SYM97__V4|186 | Bacteria |
| 1410 | B1.0|SYM97__V4|429 | Bacteria |
| 1411 | B1.0|SYM97__V4|72 | Bacteria |
| 1412 | B1.0|SYM97__V4|125 | Bacteria |
| 1413 | B1.0|SYM97__V4|240 | Bacteria |
| 1414 | B1.0|SYM97__V4|266 | Bacteria |
| 1415 | B1.0|SYM97__V4|1270 | Bacteria |
| 1416 | B1.0|SYM97__V4|279 | Bacteria |
| 1417 | B1.0|SYM97__V4|1276 | Bacteria |
| 1418 | B1.0|SYM97__V4|1220 | Bacteria |
| 1419 | B1.0|SYM97__V4|181 | Bacteria |
| 1420 | B1.0|SYM97__V4|129 | Bacteria |
| 1421 | B1.0|SYM97__V4|1504 | Bacteria |
| 1422 | B1.0|SYM97__V4|499 | Bacteria |
| 1423 | B1.0|SYM97__V4|338 | Bacteria |
| 1424 | B1.0|SYM97__V4|101 | Bacteria |
| 1425 | B1.0|SYM97__V4|245 | Bacteria |
| 1426 | B1.0|SYM97__V4|114 | Bacteria |
| 1427 | B1.0|SYM97__V4|90 | Bacteria |
| 1428 | B1.0|SYM97__V4|251 | Bacteria |
| 1429 | B1.0|SYM97__V4|91 | Bacteria |
| 1430 | B1.0|SYM97__V4|819 | Bacteria |
| 1431 | B1.0|SYM97__V4|183 | Bacteria |
| 1432 | B1.0|SYM97__V4|393 | Bacteria |
| 1433 | B1.0|SYM97__V4|303 | Bacteria |
| 1434 | B1.0|SYM97__V4|229 | Bacteria |
| 1435 | B1.0|SYM97__V4|54 | Bacteria |
| 1436 | B1.0|SYM97__V4|255 | Bacteria |
| 1437 | B1.0|SYM97__V4|506 | Bacteria |
| 1438 | B1.0|SYM97__V4|580 | Bacteria |
| 1439 | B1.0|SYM97__V4|666 | Bacteria |
| 1440 | B1.0|SYM97__V4|930 | Bacteria |
| 1441 | B1.0|SYM97__V4|607 | Bacteria |
| 1442 | B1.0|SYM97__V4|204 | Bacteria |
| 1443 | B1.0|SYM97__V4|581 | Bacteria |
| 1444 | B1.0|SYM97__V4|192 | Bacteria |
| 1445 | B1.0|SYM97__V4|692 | Bacteria |
| 1446 | B1.0|SYM97__V4|1007 | Bacteria |
| 1447 | B1.0|SYM97__V4|655 | Bacteria |
| 1448 | B1.0|SYM97__V4|951 | Bacteria |
| 1449 | B1.0|SYM97__V4|946 | Bacteria |
| 1450 | B1.0|SYM97__V4|641 | Bacteria |
| 1451 | B1.0|SYM97__V4|194 | Bacteria |
| 1452 | B1.0|SYM97__V4|619 | Bacteria |
| 1453 | B1.0|SYM97__V4|376 | Bacteria |
| 1454 | B1.0|SYM97__V4|1260 | Bacteria |
| 1455 | B1.0|SYM97__V4|346 | Bacteria |
| 1456 | B1.0|SYM97__V4|643 | Bacteria |
| 1457 | B1.0|SYM97__V4|1394 | Bacteria |
| 1458 | B1.0|SYM97__V4|304 | Bacteria |
| 1459 | B1.0|SYM97__V4|544 | Bacteria |
| 1460 | B1.0|SYM97__V4|142 | Bacteria |

TABLE 17-continued

Phylogeny and OTU designation of the endophytes useful for use in the present invention.

| | | | | |
|---|---|---|---|---|
| 1461 | B1.0|SYM97__V4|184 | Bacteria | | |
| 1462 | B1.0|SYM97__V4|1202 | Bacteria | | |
| 1463 | B1.0|SYM97__V4|400 | Bacteria | | |
| 1464 | B1.0|REF99__V4|10316 | Bacteria | | |
| 1465 | B1.0|SYM97__V4|973 | Bacteria | | |
| 1466 | B1.0|SYM97__V4|441 | Bacteria | | |
| 1467 | B1.0|SYM97__V4|408 | Bacteria | | |
| 1468 | B1.0|SYM97__V4|502 | Bacteria | | |
| 1469 | B1.0|SYM97__V4|215 | Bacteria | | |
| 1470 | B1.0|SYM97__V4|76 | Bacteria | | |
| 1471 | B1.0|SYM97__V4|49 | Bacteria | | |
| 1472 | B1.0|SYM97__V4|193 | Bacteria | | |
| 1473 | B1.0|SYM97__V4|714 | Bacteria | | |
| 1474 | B1.0|SYM97__V4|57 | Bacteria | | |
| 1475 | B1.0|SYM97__V4|302 | Bacteria | | |
| 1476 | B1.0|SYM97__V4|260 | Bacteria | | |
| 1477 | F1.0|SYM97__ITS1F|705 | Fungi | Ascomycota | ¾Sordariomycetes |
| 1478 | F1.0|UDYN__ITS1F|249 | Fungi | Ascomycota | Dothideomycetes |
| 1479 | F1.0|UDYN__ITS1F|403 | Fungi | Ascomycota | Dothideomycetes |
| 1480 | F1.0|UDYN__ITS1F|280 | Fungi | Ascomycota | Dothideomycetes |
| 1481 | F1.0|UDYN__ITS1F|548 | Fungi | Ascomycota | Dothideomycetes |
| 1482 | F1.0|UDYN__ITS1F|617 | Fungi | Ascomycota | Dothideomycetes |
| 1483 | F1.0|UDYN__ITS1F|316 | Fungi | Ascomycota | Dothideomycetes |
| 1484 | F1.0|UDYN__ITS1F|4 | Fungi | Ascomycota | Dothideomycetes |
| 1485 | F1.0|UDYN__ITS1F|242, F1.0|U97__ITS1F|242 | Fungi | Ascomycota | Dothideomycetes |
| 1486 | F1.0|UDYN__ITS1F|318, F1.0|U97__ITS1F|318 | Fungi | Ascomycota | Dothideomycetes |
| 1487 | F1.0|UDYN__ITS1F|371, F1.0|U97__ITS1F|371 | Fungi | Ascomycota | Dothideomycetes |
| 1488 | F1.0|UDYN__ITS1F|550, F1.0|U97__ITS1F|550 | Fungi | Ascomycota | Dothideomycetes |
| 1489 | F1.0|UDYN__ITS1F|76, F1.0|U97__ITS1F|76 | Fungi | Ascomycota | Dothideomycetes |
| 1490 | F1.0|U97__ITS1F|225 | Fungi | Ascomycota | Dothideomycetes |
| 1491 | F1.0|UDYN__ITS1F|407 | Fungi | Ascomycota | Dothideomycetes |
| 1492 | F1.0|UDYN__ITS1F|121 | Fungi | Ascomycota | Dothideomycetes |
| 1493 | F1.0|UDYN__ITS1F|378, F1.0|U97__ITS1F|378 | Fungi | Ascomycota | Dothideomycetes |
| 1494 | F1.0|UDYN__ITS1F|494, F1.0|U97__ITS1F|494 | Fungi | Ascomycota | Dothideomycetes |
| 1495 | F1.0|UDYN__ITS1F|493 | Fungi | Ascomycota | Dothideomycetes |
| 1496 | F1.0|UDYN__ITS1F|72 | Fungi | Ascomycota | Dothideomycetes |
| 1497 | F1.0|UDYN__ITS1F|566 | Fungi | Ascomycota | Dothideomycetes |
| 1498 | F1.0|UDYN__ITS1F|28 | Fungi | Ascomycota | Dothideomycetes |
| 1499 | F1.0|UDYN__ITS1F|85, F1.0|U97__ITS1F|85 | Fungi | Ascomycota | Dothideomycetes |
| 1500 | F1.0|U97__ITS1F|608 | Fungi | Ascomycota | Dothideomycetes |
| 1501 | F1.0|UDYN__ITS1F|509 | Fungi | Ascomycota | Dothideomycetes |
| 1502 | F1.0|UDYN__ITS1F|35 | Fungi | Ascomycota | Dothideomycetes |
| 1503 | F1.0|SYM97__ITS1F|290 | Fungi | Ascomycota | Dothideomycetes |
| 1504 | F1.0|UDYN__ITS1F|588, F1.0|U97__ITS1F|588 | Fungi | Ascomycota | Dothideomycetes |
| 1505 | F1.0|UDYN__ITS1F|185, F1.0|U97__ITS1F|185 | Fungi | Ascomycota | Dothideomycetes |
| 1506 | F1.0|UDYN__ITS1F|512, F1.0|U97__ITS1F|512 | Fungi | Ascomycota | Dothideomycetes |
| 1507 | F1.0|UDYN__ITS1F|456, F1.0|U97__ITS1F|456 | Fungi | Ascomycota | Dothideomycetes |
| 1508 | F1.0|UDYN__ITS1F|594 | Fungi | Ascomycota | Dothideomycetes |
| 1509 | F1.0|UDYN__ITS1F|547, F1.0|U97__ITS1F|547 | Fungi | Ascomycota | Dothideomycetes |
| 1510 | F1.0|SYM97__ITS1F|6 | Fungi | Ascomycota | Dothideomycetes |
| 1511 | F1.0|UDYN__ITS1F|215, F1.0|U97__ITS1F|215 | Fungi | Ascomycota | Dothideomycetes |
| 1512 | F1.0|SYM97__ITS1F|36 | Fungi | Ascomycota | Dothideomycetes |
| 1513 | F1.0|UDYN__ITS1F|98 | Fungi | Ascomycota | Dothideomycetes |
| 1514 | F1.0|SYM97__ITS1F|369 | Fungi | Ascomycota | Dothideomycetes |
| 1515 | F1.0|SYM97__ITS1F|31 | Fungi | Ascomycota | Dothideomycetes |
| 1516 | F1.0|SYM97__ITS1F|38 | Fungi | Ascomycota | Dothideomycetes |
| 1517 | F1.0|UDYN__ITS1F|567 | Fungi | Ascomycota | Dothideomycetes |
| 1518 | F1.0|UDYN__ITS1F|502, F1.0|U97__ITS1F|502 | Fungi | Ascomycota | Dothideomycetes |
| 1519 | F1.0|U97__ITS1F|338 | Fungi | Ascomycota | Dothideomycetes |
| 1520 | F1.0|UDYN__ITS1F|265 | Fungi | Ascomycota | Dothideomycetes |
| 1521 | F1.0|UDYN__ITS1F|73 | Fungi | Ascomycota | Dothideomycetes |

TABLE 17-continued

Phylogeny and OTU designation of the endophytes useful for use in the present invention.

| | | | | |
|---|---|---|---|---|
| 1522 | F1.0|UDYN_ITS1F|5 | Fungi | Ascomycota | Dothideomycetes |
| 1523 | F1.0|UDYN_ITS1F|486, F1.0|U97_ITS1F|486 | Fungi | Ascomycota | Dothideomycetes |
| 1524 | F1.0|UDYN_ITS1F|393 | Fungi | Ascomycota | Dothideomycetes |
| 1525 | F1.0|UDYN_ITS1F|385 | Fungi | Ascomycota | Dothideomycetes |
| 1526 | F1.0|UDYN_ITS1F|305 | Fungi | Ascomycota | Dothideomycetes |
| 1527 | F1.0|SYM97_ITS1F|61 | Fungi | Ascomycota | Eurotiomycetes |
| 1528 | F1.0|UDYN_ITS1F|405 | Fungi | Ascomycota | Eurotiomycetes |
| 1529 | F1.0|UDYN_ITS1F|80, F1.0|U97_ITS1F|80 | Fungi | Ascomycota | Eurotiomycetes |
| 1530 | F1.0|UDYN_ITS1F|579 | Fungi | Ascomycota | Eurotiomycetes |
| 1531 | F1.0|UDYN_ITS1F|12, F1.0|U97_ITS1F|12 | Fungi | Ascomycota | Eurotiomycetes |
| 1532 | F1.0|UDYN_ITS1F|589 | Fungi | Ascomycota | Eurotiomycetes |
| 1533 | F1.0|UDYN_ITS1F|458 | Fungi | Ascomycota | Eurotiomycetes |
| 1534 | F1.0|UDYN_ITS1F|460 | Fungi | Ascomycota | Eurotiomycetes |
| 1535 | F1.0|UDYN_ITS1F|17, F1.0|U97_ITS1F|17 | Fungi | Ascomycota | Eurotiomycetes |
| 1536 | F1.0|UDYN_ITS1F|614 | Fungi | Ascomycota | Eurotiomycetes |
| 1537 | F1.0|U97_ITS1F|129 | Fungi | Ascomycota | Eurotiomycetes |
| 1538 | F1.0|UDYN_ITS1F|113, F1.0|U97_ITS1F|113 | Fungi | Ascomycota | Eurotiomycetes |
| 1539 | F1.0|UDYN_ITS1F|241 | Fungi | Ascomycota | Eurotiomycetes |
| 1540 | F1.0|U97_ITS1F|130 | Fungi | Ascomycota | Eurotiomycetes |
| 1541 | F1.0|UDYN_ITS1F|641 | Fungi | Ascomycota | Eurotiomycetes |
| 1542 | F1.0|UDYN_ITS1F|146, F1.0|U97_ITS1F|146 | Fungi | Ascomycota | Eurotiomycetes |
| 1543 | F1.0|UDYN_ITS1F|353 | Fungi | Ascomycota | Eurotiomycetes |
| 1544 | F1.0|UDYN_ITS1F|391 | Fungi | Ascomycota | Eurotiomycetes |
| 1545 | F1.0|UDYN_ITS1F|516, F1.0|U97_ITS1F|516 | Fungi | Ascomycota | Eurotiomycetes |
| 1546 | F1.0|U97_ITS1F|223 | Fungi | Ascomycota | Eurotiomycetes |
| 1547 | F1.0|UDYN_ITS1F|446 | Fungi | Ascomycota | Eurotiomycetes |
| 1548 | F1.0|UDYN_ITS1F|520 | Fungi | Ascomycota | Eurotiomycetes |
| 1549 | F1.0|UDYN_ITS1F|230 | Fungi | Ascomycota | Eurotiomycetes |
| 1550 | F1.0|UDYN_ITS1F|409 | Fungi | Ascomycota | Eurotiomycetes |
| 1551 | F1.0|UDYN_ITS1F|392 | Fungi | Ascomycota | Eurotiomycetes |
| 1552 | F1.0|UDYN_ITS1F|9 | Fungi | Ascomycota | Eurotiomycetes |
| 1553 | F1.0|UDYN_ITS1F|19, F1.0|U97_ITS1F|19 | Fungi | Ascomycota | Eurotiomycetes |
| 1554 | F1.0|U97_ITS1F|382 | Fungi | Ascomycota | Eurotiomycetes |
| 1555 | F1.0|UDYN_ITS1F|320, F1.0|U97_ITS1F|320 | Fungi | Ascomycota | Eurotiomycetes |
| 1556 | F1.0|U97_ITS1F|478 | Fungi | Ascomycota | Eurotiomycetes |
| 1557 | F1.0|UDYN_ITS1F|621 | Fungi | Ascomycota | Eurotiomycetes |
| 1558 | F1.0|UDYN_ITS1F|610 | Fungi | Ascomycota | Eurotiomycetes |
| 1559 | F1.0|UDYN_ITS1F|233 | Fungi | Ascomycota | Eurotiomycetes |
| 1560 | F1.0|SYM97_ITS1F|42 | Fungi | Ascomycota | Eurotiomycetes |
| 1561 | F1.0|UDYN_ITS1F|568 | Fungi | Ascomycota | Leotiomycetes |
| 1562 | F1.0|UDYN_ITS1F|151 | Fungi | Ascomycota | Leotiomycetes |
| 1563 | F1.0|U97_ITS1F|139 | Fungi | Ascomycota | Leotiomycetes |
| 1564 | F1.0|UDYN_ITS1F|513 | Fungi | Ascomycota | Orbiliomycetes |
| 1565 | F1.0|UDYN_ITS1F|345, F1.0|U97_ITS1F|345 | Fungi | Ascomycota | Saccharomycetes |
| 1566 | F1.0|UDYN_ITS1F|450 | Fungi | Ascomycota | Saccharomycetes |
| 1567 | F1.0|UDYN_ITS1F|596 | Fungi | Ascomycota | Saccharomycetes |
| 1568 | F1.0|UDYN_ITS1F|71 | Fungi | Ascomycota | Saccharomycetes |
| 1569 | F1.0|UDYN_ITS1F|455, F1.0|U97_ITS1F|455 | Fungi | Ascomycota | Sordariomycetes |
| 1570 | F1.0|UDYN_ITS1F|564 | Fungi | Ascomycota | Sordariomycetes |
| 1571 | F1.0|UDYN_ITS1F|429 | Fungi | Ascomycota | Sordariomycetes |
| 1572 | F1.0|U97_ITS1F|256 | Fungi | Ascomycota | Sordariomycetes |
| 1573 | F1.0|UDYN_ITS1F|60, F1.0|U97_ITS1F|60 | Fungi | Ascomycota | Sordariomycetes |
| 1574 | F1.0|U97_ITS1F|479 | Fungi | Ascomycota | Sordariomycetes |
| 1575 | F1.0|UDYN_ITS1F|37, F1.0|U97_ITS1F|37 | Fungi | Ascomycota | Sordariomycetes |
| 1576 | F1.0|UDYN_ITS1F|112, F1.0|U97_ITS1F|112 | Fungi | Ascomycota | Sordariomycetes |
| 1577 | F1.0|UDYN_ITS1F|543 | Fungi | Ascomycota | Sordariomycetes |
| 1578 | F1.0|SYM97_ITS1F|147 | Fungi | Ascomycota | Sordariomycetes |
| 1579 | F1.0|SYM97_ITS1F|71 | Fungi | Ascomycota | Sordariomycetes |
| 1580 | F1.0|UDYN_ITS1F|40 | Fungi | Ascomycota | Sordariomycetes |
| 1581 | F1.0|UDYN_ITS1F|84 | Fungi | Ascomycota | Sordariomycetes |
| 1582 | F1.0|UDYN_ITS1F|304 | Fungi | Ascomycota | Sordariomycetes |
| 1583 | F1.0|UDYN_ITS1F|276 | Fungi | Ascomycota | Sordariomycetes |
| 1584 | F1.0|UDYN_ITS1F|89 | Fungi | Ascomycota | Sordariomycetes |
| 1585 | F1.0|UDYN_ITS1F|367 | Fungi | Ascomycota | Sordariomycetes |

TABLE 17-continued

Phylogeny and OTU designation of the endophytes useful for use in the present invention.

| | | | | |
|---|---|---|---|---|
| 1586 | F1.0|UDYN__ITS1F|110, F1.0|U97__ITS1F|110 | Fungi | Ascomycota | Sordariomycetes |
| 1587 | F1.0|UDYN__ITS1F|1 | Fungi | Ascomycota | Sordariomycetes |
| 1588 | F1.0|UDYN__ITS1F|638 | Fungi | Ascomycota | Sordariomycetes |
| 1589 | F1.0|UDYN__ITS1F|83 | Fungi | Ascomycota | Sordariomycetes |
| 1590 | F1.0|SYM97__ITS1F|88 | Fungi | Ascomycota | Sordariomycetes |
| 1591 | F1.0|UDYN__ITS1F|3, F1.0|U97__ITS1F|3 | Fungi | Ascomycota | Sordariomycetes |
| 1592 | F1.0|UDYN__ITS1F|627 | Fungi | Ascomycota | Sordariomycetes |
| 1593 | F1.0|UDYN__ITS1F|16 | Fungi | Ascomycota | Sordariomycetes |
| 1594 | F1.0|UDYN__ITS1F|198 | Fungi | Ascomycota | Sordariomycetes |
| 1595 | F1.0|UDYN__ITS1F|38, F1.0|U97__ITS1F|38 | Fungi | Ascomycota | Sordariomycetes |
| 1596 | F1.0|UDYN__ITS1F|508 | Fungi | Ascomycota | Sordariomycetes |
| 1597 | F1.0|SYM97__ITS1F|22 | Fungi | Ascomycota | Sordariomycetes |
| 1598 | F1.0|UDYN__ITS1F|344 | Fungi | Ascomycota | Sordariomycetes |
| 1599 | F1.0|UDYN__ITS1F|598 | Fungi | Ascomycota | Sordariomycetes |
| 1600 | F1.0|UDYN__ITS1F|519 | Fungi | Ascomycota | Sordariomycetes |
| 1601 | F1.0|UDYN__ITS1F|412 | Fungi | Ascomycota | Sordariomycetes |
| 1602 | F1.0|U97__ITS1F|532 | Fungi | Ascomycota | Sordariomycetes |
| 1603 | F1.0|UDYN__ITS1F|348 | Fungi | Ascomycota | |
| 1604 | F1.0|UDYN__ITS1F|438 | Fungi | Ascomycota | |
| 1605 | F1.0|UDYN__ITS1F|6 | Fungi | Ascomycota | |
| 1606 | F1.0|UDYN__ITS1F|642 | Fungi | Ascomycota | |
| 1607 | F1.0|UDYN__ITS1F|400, F1.0|U97__ITS1F|400 | Fungi | Ascomycota | |
| 1608 | F1.0|UDYN__ITS1F|14 | Fungi | Ascomycota | |
| 1609 | F1.0|UDYN__ITS1F|103 | Fungi | Ascomycota | |
| 1610 | F1.0|UDYN__ITS1F|602 | Fungi | Ascomycota | |
| 1611 | F1.0|UDYN__ITS1F|232 | Fungi | Ascomycota | |
| 1612 | F1.0|UDYN__ITS1F|483 | Fungi | Ascomycota | |
| 1613 | F1.0|UDYN__ITS1F|137 | Fungi | Ascomycota | |
| 1614 | F1.0|UDYN__ITS1F|592 | Fungi | Basidiomycota | Agaricomycetes |
| 1615 | F1.0|UDYN__ITS1F|92 | Fungi | Basidiomycota | Agaricomycetes |
| 1616 | F1.0|UDYN__ITS1F|365 | Fungi | Basidiomycota | Agaricomycetes |
| 1617 | F1.0|UDYN__ITS1F|125 | Fungi | Basidiomycota | Agaricomycetes |
| 1618 | F1.0|UDYN__ITS1F|262 | Fungi | Basidiomycota | Agaricomycetes |
| 1619 | F1.0|UDYN__ITS1F|562 | Fungi | Basidiomycota | Agaricomycetes |
| 1620 | F1.0|U97__ITS1F|372 | Fungi | Basidiomycota | Cystobasidiomycetes |
| 1621 | F1.0|UDYN__ITS1F|528, F1.0|U97__ITS1F|528 | Fungi | Basidiomycota | Microbotryomycetes |
| 1622 | F1.0|UDYN__ITS1F|643 | Fungi | Basidiomycota | Microbotryomycetes |
| 1623 | F1.0|UDYN__ITS1F|604 | Fungi | Basidiomycota | Microbotryomycetes |
| 1624 | F1.0|UDYN__ITS1F|644, F1.0|U97__ITS1F|644 | Fungi | Basidiomycota | Microbotryomycetes |
| 1625 | F1.0|U97__ITS1F|165 | Fungi | Basidiomycota | Microbotryomycetes |
| 1626 | F1.0|UDYN__ITS1F|465 | Fungi | Basidiomycota | Microbotryomycetes |
| 1627 | F1.0|UDYN__ITS1F|538 | Fungi | Basidiomycota | Microbotryomycetes |
| 1628 | F1.0|UDYN__ITS1F|77, F1.0|U97__ITS1F|77 | Fungi | Basidiomycota | Microbotryomycetes |
| 1629 | F1.0|UDYN__ITS1F|603, F1.0|U97__ITS1F|603 | Fungi | Basidiomycota | Microbotryomycetes |
| 1630 | F1.0|UDYN__ITS1F|68, F1.0|U97__ITS1F|68 | Fungi | Basidiomycota | Microbotryomycetes |
| 1631 | F1.0|UDYN__ITS1F|184 | Fungi | Basidiomycota | Tremellomycetes |
| 1632 | F1.0|U97__ITS1F|468 | Fungi | Basidiomycota | Tremellomycetes |
| 1633 | F1.0|UDYN__ITS1F|593 | Fungi | Basidiomycota | Tremellomycetes |
| 1634 | F1.0|UDYN__ITS1F|302 | Fungi | Basidiomycota | Tremellomycetes |
| 1635 | F1.0|U97__ITS1F|426 | Fungi | Basidiomycota | Tremellomycetes |
| 1636 | F1.0|U97__ITS1F|427 | Fungi | Basidiomycota | Tremellomycetes |
| 1637 | F1.0|UDYN__ITS1F|526, F1.0|U97__ITS1F|526 | Fungi | Basidiomycota | Tremellomycetes |
| 1638 | F1.0|U97__ITS1F|87 | Fungi | Basidiomycota | Tremellomycetes |
| 1639 | F1.0|UDYN__ITS1F|191, F1.0|U97__ITS1F|191 | Fungi | Basidiomycota | Tremellomycetes |
| 1640 | F1.0|UDYN__ITS1F|419 | Fungi | Basidiomycota | Tremellomycetes |
| 1641 | F1.0|UDYN__ITS1F|240 | Fungi | Basidiomycota | Tremellomycetes |
| 1642 | F1.0|UDYN__ITS1F|286 | Fungi | Basidiomycota | Tremellomycetes |
| 1643 | F1.0|UDYN__ITS1F|354 | Fungi | Basidiomycota | |
| 1644 | F1.0|U97__ITS1F|206 | Fungi | Zygomycota | Incertae sedis |
| 1645 | F1.0|UDYN__ITS1F|572 | Fungi | Zygomycota | Incertae sedis |
| 1646 | F1.0|U97__ITS1F|106 | Fungi | Zygomycota | Incertae sedis |
| 1647 | F1.0|U97__ITS1F|142 | Fungi | Zygomycota | Incertae sedis |
| 1648 | F1.0|UDYN__ITS1F|30 | Fungi | Zygomycota | Incertae sedis |
| 1649 | F1.0|SYM97__ITS1F|741 | Fungi | | |
| 1650 | F1.0|SYM97__ITS1F|60 | Fungi | | |
| 1651 | F1.0|SYM97__ITS1F|112 | Fungi | | |
| 1652 | F1.0|SYM97__ITS1F|700 | Fungi | | |

TABLE 17-continued

Phylogeny and OTU designation of the endophytes useful for use in the present invention.

| | | |
|---|---|---|
| 1653 | F1.0|SYM97_ITS1F|67 | Fungi |
| 1654 | F1.0|SYM97_ITS1F|264 | Fungi |
| 1655 | F1.0|UDYN_ITS1F|628, F1.0|U97_ITS1F|628 | Fungi |
| 1656 | F1.0|SYM97_ITS1F|173 | Fungi |
| 1657 | F1.0|SYM97_ITS1F|44 | Fungi |
| 1658 | F1.0|SYM97_ITS1F|97 | Fungi |
| 1659 | F1.0|UDYN_ITS1F|29 | Fungi |
| 1660 | F1.0|SYM97_ITS1F|709 | Fungi |
| 1661 | F1.0|SYM97_ITS1F|503 | Fungi |
| 1662 | F1.0|SYM97_ITS1F|708 | Fungi |
| 1663 | F1.0|SYM97_ITS1F|191 | Fungi |
| 1664 | F1.0|SYM97_ITS1F|698 | Fungi |
| 1665 | F1.0|SYM97_ITS1F|288 | Fungi |
| 1666 | F1.0|SYM97_ITS1F|218 | Fungi |
| 1667 | F1.0|SYM97_ITS1F|750 | Fungi |
| 1668 | F1.0|SYM97_ITS1F|40 | Fungi |
| 1669 | F1.0|SYM97_ITS1F|86 | Fungi |
| 1670 | F1.0|SYM97_ITS1F|724 | Fungi |
| 1671 | F1.0|SYM97_ITS1F|272 | Fungi |
| 1672 | F1.0|UDYN_ITS1F|451 | Fungi |
| 1673 | F1.0|SYM97_ITS1F|122 | Fungi |
| 1674 | F1.0|SYM97_ITS1F|18 | Fungi |
| 1675 | F1.0|SYM97_ITS1F|171 | Fungi |
| 1676 | F1.0|UDYN_ITS1F|102 | Fungi |
| 1677 | F1.0|SYM97_ITS1F|418 | Fungi |
| 1678 | F1.0|SYM97_ITS1F|743 | Fungi |
| 1679 | F1.0|SYM97_ITS1F|354 | Fungi |
| 1680 | F1.0|UDYN_ITS1F|613 | Fungi |
| 1681 | F1.0|SYM97_ITS1F|75 | Fungi |
| 1682 | F1.0|SYM97_ITS1F|74 | Fungi |
| 1683 | F1.0|SYM97_ITS1F|51 | Fungi |
| 1684 | F1.0|SYM97_ITS1F|462 | Fungi |
| 1685 | F1.0|SYM97_ITS1F|34 | Fungi |
| 1686 | F1.0|SYM97_ITS1F|1 | Fungi |
| 1687 | F1.0|SYM97_ITS1F|99 | Fungi |
| 1688 | F1.0|SYM97_ITS1F|62 | Fungi |
| 1689 | F1.0|SYM97_ITS1F|151 | Fungi |
| 1690 | F1.0|UDYN_ITS1F|463, F1.0|U97_ITS1F|463 | Fungi |
| 1691 | F1.0|SYM97_ITS1F|718 | Fungi |
| 1692 | F1.0|SYM97_ITS1F|2 | Fungi |
| 1693 | F1.0|SYM97_ITS1F|158 | Fungi |
| 1694 | F1.0|SYM97_ITS1F|20 | Fungi |

| SEQ ID | Order | Family | Genus |
|---|---|---|---|
| 1 | Acidobacteriales | Acidobacteriaceae_(Subgroup_1) | *Granulicella* |
| 2 | Acidobacteriales | Acidobacteriaceae_(Subgroup_1) | |
| 3 | Acidobacteriales | Acidobacteriaceae_(Subgroup_1) | |
| 4 | Acidobacteriales | Acidobacteriaceae_(Subgroup_1) | |
| 5 | Acidobacteriales | Acidobacteriaceae_(Subgroup_1) | |
| 6 | Acidobacteriales | Acidobacteriaceae_(Subgroup_1) | |
| 7 | Acidobacteriales | Acidobacteriaceae_(Subgroup_1) | |
| 8 | Acidobacteriales | Acidobacteriaceae_(Subgroup_1) | |
| 9 | Acidobacteriales | Acidobacteriaceae_(Subgroup_1) | |
| 10 | Acidobacteriales | Acidobacteriaceae_(Subgroup_1) | |
| 11 | Acidobacteriales | Acidobacteriaceae_(Subgroup_1) | |
| 12 | Acidobacteriales | Acidobacteriaceae_(Subgroup_1) | |
| 13 | Subgroup_2 | | |
| 14 | Subgroup_2 | | |
| 15 | Subgroup_3 | Unknown_Family | *Bryobacter* |
| 16 | Subgroup_3 | Unknown_Family | *Bryobacter* |
| 17 | Subgroup_3 | Unknown_Family | |
| 18 | Subgroup_3 | Unknown_Family | |
| 19 | Subgroup_3 | Unknown_Family | |

TABLE 17-continued

Phylogeny and OTU designation of the endophytes useful for use in the present invention.

| | | | |
|---|---|---|---|
| 20 | Subgroup_3 | Unknown_Family | |
| 21 | Subgroup_4 | RB41 | |
| 22 | Subgroup_4 | RB41 | |
| 23 | Subgroup_4 | RB41 | |
| 24 | Subgroup_4 | RB41 | |
| 25 | Subgroup_4 | RB41 | |
| 26 | Subgroup_4 | RB41 | |
| 27 | Subgroup_4 | RB41 | |
| 28 | Subgroup_4 | RB41 | |
| 29 | Subgroup_4 | Unknown_Family | *Blastocatella* |
| 30 | Subgroup_4 | Unknown_Family | |
| 31 | Subgroup_4 | Unknown_Family | |
| 32 | Subgroup_4 | Unknown_Family | |
| 33 | Subgroup_4 | Unknown_Family | |
| 34 | Subgroup_4 | Unknown_Family | |
| 35 | Subgroup_4 | Unknown_Family | |
| 36 | Subgroup_6 | | |
| 37 | Subgroup_6 | | |
| 38 | Subgroup_6 | | |
| 39 | Subgroup_6 | | |
| 40 | Subgroup_6 | | |
| 41 | Subgroup_6 | | |
| 42 | iii1-15 | RB40 | |
| 43 | Acidobacteriales | Acidobacteriaceae | |
| 44 | Acidobacteriales | Acidobacteriaceae | |
| 45 | Acidobacteriales | Koribacteraceae | |
| 46 | Subgroup_7 | | |
| 47 | Subgroup_7 | | |
| 48 | Solibacterales | Solibacteraceae | |
| 49 | Acidimicrobiales | Iamiaceae | |
| 50 | Acidimicrobiales | Iamiaceae | |
| 51 | Acidimicrobiales | | |
| 52 | Acidimicrobiales | | |
| 53 | Acidimicrobiales | | |
| 54 | Actinomycetales | Cellulomonadaceae | |
| 55 | Actinomycetales | Frankiaceae | |
| 56 | Actinomycetales | Intrasporangiaceae | |
| 57 | Actinomycetales | Kineosporiaceae | |
| 58 | Actinomycetales | Microbacteriaceae | |
| 59 | Actinomycetales | Microbacteriaceae | |
| 60 | Actinomycetales | Micrococcaceae | |
| 61 | Actinomycetales | Micrococcaceae | |
| 62 | Actinomycetales | Streptomycetaceae | |
| 63 | Actinomycetales | | |
| 64 | Corynebacteriales | Corynebacteriaceae | |
| 65 | Corynebacteriales | Corynebacteriaceae | |
| 66 | Corynebacteriales | Corynebacteriaceae | |
| 67 | Corynebacteriales | Corynebacteriaceae | |
| 68 | Corynebacteriales | Corynebacteriaceae | |
| 69 | Corynebacteriales | Mycobacteriaceae | |
| 70 | Corynebacteriales | Mycobacteriaceae | |
| 71 | Corynebacteriales | Mycobacteriaceae | |
| 72 | Corynebacteriales | Mycobacteriaceae | |
| 73 | Corynebacteriales | Mycobacteriaceae | |
| 74 | Corynebacteriales | Mycobacteriaceae | |
| 75 | Corynebacteriales | Mycobacteriaceae | |
| 76 | Corynebacteriales | Mycobacteriaceae | |
| 77 | Corynebacteriales | Mycobacteriaceae | |
| 78 | Corynebacteriales | Nocardiaceae | |
| 79 | Corynebacteriales | Nocardiaceae | |
| 80 | Corynebacteriales | Nocardiaceae | |
| 81 | Corynebacteriales | Segniliparaceae | |
| 82 | Frankiales | Acidothermaceae | |
| 83 | Frankiales | Geodermatophilaceae | |
| 84 | Frankiales | Geodermatophilaceae | |
| 85 | Frankiales | Geodermatophilaceae | |
| 86 | Frankiales | Nakamurellaceae | *Nakamurella* |
| 87 | Frankiales | Sporichthyaceae | |
| 88 | Frankiales | | |
| 89 | Glycomycetales | Gly cornycetaceae | |
| 90 | Kineosporiales | Kineosporiaceae | |
| 91 | Kineosporiales | Kineosporiaceae | |
| 92 | Kineosporiales | Kineosporiaceae | |
| 93 | Kineosporiales | Kineosporiaceae | |
| 94 | Kineosporiales | Kineosporiaceae | |
| 95 | Kineosporiales | Kineosporiaceae | |
| 96 | Micrococcales | Brevibacteriaceae | |
| 97 | Micrococcales | Cellulomonadaceae | |

TABLE 17-continued

Phylogeny and OTU designation of the endophytes useful for use in the present invention.

| | | | |
|---|---|---|---|
| 98 | Micrococcales | Cellulomonadaceae | |
| 99 | Micrococcales | Dermabacteraceae | |
| 100 | Micrococcales | Dermabacteraceae | |
| 101 | Micrococcales | Dermacoccaceae | |
| 102 | Micrococcales | Dermacoccaceae | |
| 103 | Micrococcales | Intrasporangiaceae | |
| 104 | Micrococcales | Microbacteriaceae | |
| 105 | Micrococcales | Microbacteriaceae | |
| 106 | Micrococcales | Microbacteriaceae | |
| 107 | Micrococcales | Microbacteriaceae | |
| 108 | Micrococcales | Microbacteriaceae | |
| 109 | Micrococcales | Microbacteriaceae | |
| 110 | Micrococcales | Microbacteriaceae | |
| 111 | Micrococcales | Microbacteriaceae | |
| 112 | Micrococcales | Microbacteriaceae | |
| 113 | Micrococcales | Microbacteriaceae | |
| 114 | Micrococcales | Microbacteriaceae | |
| 115 | Micrococcales | Microbacteriaceae | |
| 116 | Micrococcales | Microbacteriaceae | |
| 117 | Micrococcales | Microbacteriaceae | |
| 118 | Micrococcales | Microbacteriaceae | |
| 119 | Micrococcales | Microbacteriaceae | |
| 120 | Micrococcales | Microbacteriaceae | |
| 121 | Micrococcales | Microbacteriaceae | |
| 122 | Micrococcales | Microbacteriaceae | |
| 123 | Micrococcales | Micrococcaceae | |
| 124 | Micrococcales | Micrococcaceae | |
| 125 | Micrococcales | Micrococcaceae | |
| 126 | Micrococcales | Micrococcaceae | |
| 127 | Micrococcales | Micrococcaceae | |
| 128 | Micrococcales | Micrococcaceae | |
| 129 | Micrococcales | Micrococcaceae | |
| 130 | Micrococcales | Micrococcaceae | |
| 131 | Micrococcales | Micrococcaceae | |
| 132 | Micrococcales | Micrococcaceae | |
| 133 | Micrococcales | Micrococcaceae | |
| 134 | Micrococcales | Micrococcaceae | |
| 135 | Micrococcales | Micrococcaceae | |
| 136 | Micrococcales | Micrococcaceae | |
| 137 | Micrococcales | Micrococcaceae | |
| 138 | Micrococcales | Promicromonosporaceae | |
| 139 | Micrococcales | Promicromonosporaceae | |
| 140 | Micrococcales | Promicromonosporaceae | |
| 141 | Micrococcales | Sanguibacteraceae | |
| 142 | Micromonosporales | Micromonosporaceae | |
| 143 | Micromonosporales | Micromonosporaceae | |
| 144 | Micromonosporales | Micromonosporaceae | |
| 145 | Micromonosporales | Micromonosporaceae | |
| 146 | Micromonosporales | Micromonosporaceae | |
| 147 | Micromonosporales | Micromonosporaceae | |
| 148 | Micromonosporales | Micromonosporaceae | |
| 149 | Propionibacteriales | Nocardioidaceae | *Kribbella* |
| 150 | Propionibacteriales | Nocardioidaceae | *Nocardioides* |
| 151 | Propionibacteriales | Nocardioidaceae | |
| 152 | Propionibacteriales | Nocardioidaceae | |
| 153 | Propionibacteriales | Nocardioidaceae | |
| 154 | Propionibacteriales | Nocardioidaceae | |
| 155 | Propionibacteriales | Nocardioidaceae | |
| 156 | Propionibacteriales | Nocardioidaceae | |
| 157 | Propionibacteriales | Nocardioidaceae | |
| 158 | Propionibacteriales | Nocardioidaceae | |
| 159 | Propionibacteriales | Nocardioidaceae | |
| 160 | Propionibacteriales | Nocardioidaceae | |
| 161 | Propionibacteriales | Nocardioidaceae | |
| 162 | Propionibacteriales | Nocardioidaceae | |
| 163 | Propionibacteriales | Nocardioidaceae | |
| 164 | Propionibacteriales | Nocardioidaceae | |
| 165 | Propionibacteriales | Nocardioidaceae | |
| 166 | Propionibacteriales | Nocardioidaceae | |
| 167 | Pseudonocardiales | Pseudonocardiaceae | *Saccharopolyspora* |
| 168 | Pseudonocardiales | Pseudonocardiaceae | |
| 169 | Pseudonocardiales | Pseudonocardiaceae | |
| 170 | Pseudonocardiales | Pseudonocardiaceae | |
| 171 | Pseudonocardiales | Pseudonocardiaceae | |
| 172 | Pseudonocardiales | Pseudonocardiaceae | |
| 173 | Pseudonocardiales | Pseudonocardiaceae | |
| 174 | Pseudonocardiales | Pseudonocardiaceae | |
| 175 | Pseudonocardiales | Pseudonocardiaceae | |

TABLE 17-continued

Phylogeny and OTU designation of the endophytes useful for use in the present invention.

| | | |
|---|---|---|
| 176 | Pseudonocardiales | Pseudonocardiaceae |
| 177 | Pseudonocardiales | Pseudonocardiaceae |
| 178 | Streptomycetales | Streptomycetaceae |
| 179 | Streptomycetales | Streptomycetaceae |
| 180 | Streptomycetales | Streptomycetaceae |
| 181 | Streptomycetales | Streptomycetaceae |
| 182 | Streptomycetales | Streptomycetaceae |
| 183 | Streptomycetales | Streptomycetaceae |
| 184 | Streptomycetales | Streptomycetaceae |
| 185 | Streptomycetales | Streptomycetaceae |
| 186 | Streptomycetales | Streptomycetaceae |
| 187 | Streptomycetales | Streptomycetaceae |
| 188 | Streptomycetales | Streptomycetaceae |
| 189 | Streptomycetales | Streptomycetaceae |
| 190 | Streptomycetales | Streptomycetaceae |
| 191 | Streptomycetales | Streptomycetaceae |
| 192 | Streptomycetales | Streptomycetaceae |
| 193 | Streptomycetales | Streptomycetaceae |
| 194 | Streptomycetales | Streptomycetaceae |
| 195 | Streptomycetales | Streptomycetaceae |
| 196 | Rubrobacterales | Rubrobacteriaceae |
| 197 | Rubrobacterales | Rubrobacteriaceae |
| 198 | Rubrobacterales | Rubrobacteriaceae |
| 199 | Rubrobacterales | Rubrobacteriaceae |
| 200 | Gaiellales | Gaiellaceae |
| 201 | Gaiellales | |
| 202 | Gaiellales | |
| 203 | Gaiellales | |
| 204 | Solirubrobacterales | 0319-6M6 |
| 205 | Solirubrobacterales | 480-2 |
| 206 | Solirubrobacterales | 480-2 |
| 207 | Solirubrobacterales | Patulibacteraceae |
| 208 | Solirubrobacterales | Solirubrobacteraceae |
| 209 | Solirubrobacterales | Solirubrobacteraceae |
| 210 | Solirubrobacterales | Solirubrobacteraceae |
| 211 | Chthonomonadales | Chthonomonadaceae |
| 212 | | |
| 213 | | |
| 214 | Bacteroidales | Porphyromonadaceae |
| 215 | Bacteroidales | Porphyromonadaceae |
| 216 | Bacteroidales | Prevotellaceae |
| 217 | Bacteroidales | Prevotellaceae |
| 218 | Bacteroidales | Prevotellaceae |
| 219 | Bacteroidales | Prevotellaceae |
| 220 | | |
| 221 | Cytophagales | Cyclobacteriaceae |
| 222 | Cytophagales | Cyclobacteriaceae |
| 223 | Cytophagales | Cytophagaceae |
| 224 | Cytophagales | Cytophagaceae |
| 225 | Cytophagales | Cytophagaceae |
| 226 | Cytophagales | Cytophagaceae |
| 227 | Cytophagales | Cytophagaceae |
| 228 | Cytophagales | Cytophagaceae |
| 229 | Cytophagales | Cytophagaceae |
| 230 | Cytophagales | Cytophagaceae |
| 231 | Cytophagales | Cytophagaceae |
| 232 | Cytophagales | Cytophagaceae |
| 233 | Cytophagales | Cytophagaceae |
| 234 | Cytophagales | Cytophagaceae |
| 235 | Cytophagales | Cytophagaceae |
| 236 | Cytophagales | Cytophagaceae |
| 237 | Cytophagales | Cytophagaceae |
| 238 | Cytophagales | Cytophagaceae |
| 239 | Cytophagales | Cytophagaceae |
| 240 | Cytophagales | Cytophagaceae |
| 241 | Cytophagales | Cytophagaceae |
| 242 | Cytophagales | Cytophagaceae |
| 243 | Cytophagales | Cytophagaceae |
| 244 | Cytophagales | Cytophagaceae |
| 245 | Cytophagales | Cytophagaceae |
| 246 | Cytophagales | Cytophagaceae |
| 247 | Cytophagales | Cytophagaceae |
| 248 | Cytophagales | Cytophagaceae |
| 249 | Cytophagales | Cytophagaceae |
| 250 | Cytophagales | Cytophagaceae |
| 251 | Cytophagales | Cytophagaceae |
| 252 | Cytophagales | Cytophagaceae |
| 253 | Cytophagales | Cytophagaceae |

TABLE 17-continued

Phylogeny and OTU designation of the endophytes useful for use in the present invention.

| | | | |
|---|---|---|---|
| 254 | Cytophagales | Cytophagaceae | |
| 255 | Cytophagales | Cytophagaceae | |
| 256 | Cytophagales | Cytophagaceae | |
| 257 | Cytophagales | Cytophagaceae | |
| 258 | Cytophagales | Cytophagaceae | |
| 259 | Cytophagales | Cytophagaceae | |
| 260 | Cytophagales | Cytophagaceae | |
| 261 | Cytophagales | Cytophagaceae | |
| 262 | Cytophagales | Cytophagaceae | |
| 263 | Cytophagales | Cytophagaceae | |
| 264 | Cytophagales | Cytophagaceae | |
| 265 | Cytophagales | Cytophagaceae | |
| 266 | Cytophagales | Cytophagaceae | |
| 267 | Cytophagales | Cytophagaceae | |
| 268 | Cytophagales | Cytophagaceae | |
| 269 | Cytophagales | Cytophagaceae | |
| 270 | Cytophagales | Cytophagaceae | |
| 271 | Cytophagales | Cytophagaceae | |
| 272 | Cytophagales | Cytophagaceae | |
| 273 | Cytophagales | Cytophagaceae | |
| 274 | Cytophagales | Flammeovirgaceae | *Marinoscillum* |
| 275 | Cytophagales | Flammeovirgaceae | |
| 276 | Cytophagales | Flammeovirgaceae | |
| 277 | Cytophagales | Flammeovirgaceae | |
| 278 | Flavobacteriales | Cryomorphaceae | |
| 279 | Flavobacteriales | Cryomorphaceae | |
| 280 | Flavobacteriales | Flavobacteriaceae | *Flavobacterium* |
| 281 | Flavobacteriales | Flavobacteriaceae | *Flavobacterium* |
| 282 | Flavobacteriales | Flavobacteriaceae | |
| 283 | Flavobacteriales | Flavobacteriaceae | |
| 284 | Flavobacteriales | Flavobacteriaceae | |
| 285 | Flavobacteriales | Flavobacteriaceae | |
| 286 | Flavobacteriales | Flavobacteriaceae | |
| 287 | Flavobacteriales | Flavobacteriaceae | |
| 288 | Flavobacteriales | Flavobacteriaceae | |
| 289 | Flavobacteriales | Flavobacteriaceae | |
| 290 | Flavobacteriales | Flavobacteriaceae | |
| 291 | Flavobacteriales | Flavobacteriaceae | |
| 292 | Flavobacteriales | Flavobacteriaceae | |
| 293 | Flavobacteriales | Flavobacteriaceae | |
| 294 | Flavobacteriales | Flavobacteriaceae | |
| 295 | Flavobacteriales | Flavobacteriaceae | |
| 296 | Flavobacteriales | Flavobacteriaceae | |
| 297 | Flavobacteriales | Flavobacteriaceae | |
| 298 | Flavobacteriales | Flavobacteriaceae | |
| 299 | Flavobacteriales | Flavobacteriaceae | |
| 300 | Flavobacteriales | Flavobacteriaceae | |
| 301 | Flavobacteriales | Flavobacteriaceae | |
| 302 | Flavobacteriales | Flavobacteriaceae | |
| 303 | Flavobacteriales | Flavobacteriaceae | |
| 304 | Flavobacteriales | Flavobacteriaceae | |
| 305 | Flavobacteriales | Flavobacteriaceae | |
| 306 | Flavobacteriales | Flavobacteriaceae | |
| 307 | Flavobacteriales | Flavobacteriaceae | |
| 308 | Flavobacteriales | Flavobacteriaceae | |
| 309 | Flavobacteriales | Weeksellaceae | |
| 310 | Flavobacteriales | Weeksellaceae | |
| 311 | Saprospirales | Chitinophagaceae | |
| 312 | Saprospirales | Chitinophagaceae | |
| 313 | Saprospirales | Chitinophagaceae | |
| 314 | Saprospirales | Chitinophagaceae | |
| 315 | Saprospirales | Chitinophagaceae | |
| 316 | Saprospirales | Chitinophagaceae | |
| 317 | Saprospirales | Chitinophagaceae | |
| 318 | Saprospirales | Chitinophagaceae | |
| 319 | Saprospirales | Chitinophagaceae | |
| 320 | Saprospirales | Chitinophagaceae | |
| 321 | Saprospirales | Chitinophagaceae | |
| 322 | Saprospirales | Chitinophagaceae | |
| 323 | Sphingobacteriales | AKYH767 | |
| 324 | Sphingobacteriales | AKYH767 | |
| 325 | Sphingobacteriales | Chitinophagaceae | *Ferruginibacter* |
| 326 | Sphingobacteriales | Chitinophagaceae | *Flavisolibacter* |
| 327 | Sphingobacteriales | Chitinophagaceae | *Terrimonas* |
| 328 | Sphingobacteriales | Chitinophagaceae | |
| 329 | Sphingobacteriales | Chitinophagaceae | |
| 330 | Sphingobacteriales | Chitinophagaceae | |
| 331 | Sphingobacteriales | Chitinophagaceae | |

TABLE 17-continued

Phylogeny and OTU designation of the endophytes useful for use in the present invention.

| | | |
|---|---|---|
| 332 | Sphingobacteriales | Chitinophagaceae |
| 333 | Sphingobacteriales | Chitinophagaceae |
| 334 | Sphingobacteriales | Chitinophagaceae |
| 335 | Sphingobacteriales | Chitinophagaceae |
| 336 | Sphingobacteriales | Chitinophagaceae |
| 337 | Sphingobacteriales | Chitinophagaceae |
| 338 | Sphingobacteriales | Chitinophagaceae |
| 339 | Sphingobacteriales | Chitinophagaceae |
| 340 | Sphingobacteriales | Chitinophagaceae |
| 341 | Sphingobacteriales | Chitinophagaceae |
| 342 | Sphingobacteriales | Chitinophagaceae |
| 343 | Sphingobacteriales | Chitinophagaceae |
| 344 | Sphingobacteriales | Chitinophagaceae |
| 345 | Sphingobacteriales | Chitinophagaceae |
| 346 | Sphingobacteriales | Chitinophagaceae |
| 347 | Sphingobacteriales | Chitinophagaceae |
| 348 | Sphingobacteriales | Chitinophagaceae |
| 349 | Sphingobacteriales | Chitinophagaceae |
| 350 | Sphingobacteriales | Chitinophagaceae |
| 351 | Sphingobacteriales | Chitinophagaceae |
| 352 | Sphingobacteriales | Chitinophagaceae |
| 353 | Sphingobacteriales | Chitinophagaceae |
| 354 | Sphingobacteriales | Chitinophagaceae |
| 355 | Sphingobacteriales | Chitinophagaceae |
| 356 | Sphingobacteriales | Chitinophagaceae |
| 357 | Sphingobacteriales | Chitinophagaceae |
| 358 | Sphingobacteriales | Chitinophagaceae |
| 359 | Sphingobacteriales | Chitinophagaceae |
| 360 | Sphingobacteriales | Chitinophagaceae |
| 361 | Sphingobacteriales | Chitinophagaceae |
| 362 | Sphingobacteriales | Chitinophagaceae |
| 363 | Sphingobacteriales | Chitinophagaceae |
| 364 | Sphingobacteriales | Chitinophagaceae |
| 365 | Sphingobacteriales | Chitinophagaceae |
| 366 | Sphingobacteriales | Chitinophagaceae |
| 367 | Sphingobacteriales | Chitinophagaceae |
| 368 | Sphingobacteriales | Chitinophagaceae |
| 369 | Sphingobacteriales | Chitinophagaceae |
| 370 | Sphingobacteriales | Chitinophagaceae |
| 371 | Sphingobacteriales | Chitinophagaceae |
| 372 | Sphingobacteriales | Chitinophagaceae |
| 373 | Sphingobacteriales | Chitinophagaceae |
| 374 | Sphingobacteriales | env.OPS_17 |
| 375 | Sphingobacteriales | env.OPS_17 |
| 376 | Sphingobacteriales | env.OPS_17 |
| 377 | Sphingobacteriales | KD3-93 |
| 378 | Sphingobacteriales | NS11-12_marine_group |
| 379 | Sphingobacteriales | Saprospiraceae |
| 380 | Sphingobacteriales | Saprospiraceae |
| 381 | Sphingobacteriales | Saprospiraceae |
| 382 | Sphingobacteriales | Sphingobacteriaceae |
| 383 | Sphingobacteriales | Sphingobacteriaceae |
| 384 | Sphingobacteriales | Sphingobacteriaceae |
| 385 | Sphingobacteriales | Sphingobacteriaceae |
| 386 | Sphingobacteriales | Sphingobacteriaceae |
| 387 | Sphingobacteriales | Sphingobacteriaceae |
| 388 | Sphingobacteriales | Sphingobacteriaceae |
| 389 | Sphingobacteriales | Sphingobacteriaceae |
| 390 | Sphingobacteriales | Sphingobacteriaceae |
| 391 | Sphingobacteriales | Sphingobacteriaceae |
| 392 | Sphingobacteriales | Sphingobacteriaceae |
| 393 | Sphingobacteriales | Sphingobacteriaceae |
| 394 | Sphingobacteriales | Sphingobacteriaceae |
| 395 | Sphingobacteriales | Sphingobacteriaceae |
| 396 | Sphingobacteriales | Sphingobacteriaceae |
| 397 | Sphingobacteriales | Sphingobacteriaceae |
| 398 | Sphingobacteriales | Sphingobacteriaceae |
| 399 | Sphingobacteriales | Sphingobacteriaceae |
| 400 | Sphingobacteriales | Sphingobacteriaceae |
| 401 | Sphingobacteriales | Sphingobacteriaceae |
| 402 | Sphingobacteriales | Sphingobacteriaceae |
| 403 | Sphingobacteriales | Sphingobacteriaceae |
| 404 | Sphingobacteriales | Sphingobacteriaceae |
| 405 | Sphingobacteriales | Sphingobacteriaceae |
| 406 | Sphingobacteriales | Sphingobacteriaceae |
| 407 | Sphingobacteriales | Sphingobacteriaceae |
| 408 | Sphingobacteriales | Sphingobacteriaceae |
| 409 | Sphingobacteriales | Sphingobacteriaceae |

TABLE 17-continued

Phylogeny and OTU designation of the endophytes useful for use in the present invention.

| | | | |
|---|---|---|---|
| 410 | Sphingobacteriales | Sphingobacteriaceae | |
| 411 | Sphingobacteriales | Sphingobacteriaceae | |
| 412 | Sphingobacteriales | Sphingobacteriaceae | |
| 413 | Sphingobacteriales | Sphingobacteriaceae | |
| 414 | Sphingobacteriales | Sphingobacteriaceae | |
| 415 | Sphingobacteriales | Sphingobacteriaceae | |
| 416 | Sphingobacteriales | Sphingobacteriaceae | |
| 417 | Sphingobacteriales | Sphingobacteriaceae | |
| 418 | Sphingobacteriales | Sphingobacteriaceae | |
| 419 | Sphingobacteriales | Sphingobacteriaceae | |
| 420 | Sphingobacteriales | Sphingobacteriaceae | |
| 421 | Sphingobacteriales | Sphingobacteriaceae | |
| 422 | Sphingobacteriales | Sphingobacteriaceae | |
| 423 | Sphingobacteriales | Sphingobacteriaceae | |
| 424 | Sphingobacteriales | Sphingobacteriaceae | |
| 425 | Sphingobacteriales | Sphingobacteriaceae | |
| 426 | Sphingobacteriales | Sphingobacteriaceae | |
| 427 | Sphingobacteriales | Sphingobacteriaceae | |
| 428 | Sphingobacteriales | Sphingobacteriaceae | |
| 429 | Sphingobacteriales | Sphingobacteriaceae | |
| 430 | Sphingobacteriales | Sphingobacteriaceae | |
| 431 | Sphingobacteriales | Sphingobacteriaceae | |
| 432 | Sphingobacteriales | Sphingobacteriaceae | |
| 433 | Sphingobacteriales | | |
| 434 | VC2.1_Bac22 | | |
| 435 | | | |
| 436 | Candidate_division_TM7 | | |
| 437 | Chlamydiales | Parachlamydiaceae | |
| 438 | Chlamydiales | | |
| 439 | Anaerolineales | Anaerolineaceae | |
| 440 | Anaerolineales | Anaerolineaceae | |
| 441 | Anaerolineales | Anaerolineaceae | |
| 442 | Anaerolineales | Anaerolineaceae | |
| 443 | Anaerolineales | Anaerolineaceae | |
| 444 | Anaerolineales | Anaerolineaceae | |
| 445 | SBR1031 | A4b | |
| 446 | SBR1031 | A4b | |
| 447 | Chloroflexales | Roseiflexaceae | |
| 448 | Chloroflexales | Roseiflexaceae | |
| 449 | | | |
| 450 | JG30-KF-CM45 | | |
| 451 | JG30-KF-CM45 | | |
| 452 | B07_WMSP1 | | |
| 453 | | | |
| 454 | SubsectionIII | FamilyI | *Arthronema* |
| 455 | SubsectionIII | FamilyI | |
| 456 | Cyanobacteria | | |
| 457 | Obscuribacterales | | |
| 458 | Deinococcales | Deinococcaceae | |
| 459 | 258ds10 | | |
| 460 | 258ds10 | | |
| 461 | 258ds10 | | |
| 462 | Fibrobacterales | Fibrobacteraceae | |
| 463 | Fibrobacterales | Fibrobacteraceae | |
| 464 | Fibrobacterales | Fibrobacteraceae | |
| 465 | Fibrobacterales | Fibrobacteraceae | |
| 466 | Bacillales | Alicyclobacillaceae | |
| 467 | Bacillales | Alicyclobacillaceae | |
| 468 | Bacillales | Bacillaceae | *Bacillus* |
| 469 | Bacillales | Bacillaceae | |
| 470 | Bacillales | Bacillaceae | |
| 471 | Bacillales | Bacillaceae | |
| 472 | Bacillales | Bacillaceae | |
| 473 | Bacillales | Bacillaceae | |
| 474 | Bacillales | Bacillaceae | |
| 475 | Bacillales | Bacillaceae | |
| 476 | Bacillales | Bacillaceae | |
| 477 | Bacillales | Bacillaceae | |
| 478 | Bacillales | Bacillaceae | |
| 479 | Bacillales | Bacillaceae | |
| 480 | Bacillales | Bacillaceae | |
| 481 | Bacillales | Bacillaceae | |
| 482 | Bacillales | Bacillaceae | |
| 483 | Bacillales | Bacillaceae | |
| 484 | Bacillales | Bacillaceae | |
| 485 | Bacillales | Bacillaceae | |
| 486 | Bacillales | Bacillaceae | |
| 487 | Bacillales | Bacillaceae | |

TABLE 17-continued

Phylogeny and OTU designation of the endophytes useful for use in the present invention.

| | | |
|---|---|---|
| 488 | Bacillales | Bacillaceae |
| 489 | Bacillales | Bacillaceae |
| 490 | Bacillales | Bacillaceae |
| 491 | Bacillales | Bacillaceae |
| 492 | Bacillales | Bacillaceae |
| 493 | Bacillales | Bacillaceae |
| 494 | Bacillales | Bacillaceae |
| 495 | Bacillales | Bacillaceae |
| 496 | Bacillales | Bacillaceae |
| 497 | Bacillales | Bacillaceae |
| 498 | Bacillales | Bacillaceae |
| 499 | Bacillales | Family_XII |
| 500 | Bacillales | Family_XII |
| 501 | Bacillales | Paenibacillaceae |
| 502 | Bacillales | Paenibacillaceae |
| 503 | Bacillales | Paenibacillaceae |
| 504 | Bacillales | Paenibacillaceae |
| 505 | Bacillales | Paenibacillaceae |
| 506 | Bacillales | Paenibacillaceae |
| 507 | Bacillales | Paenibacillaceae |
| 508 | Bacillales | Paenibacillaceae |
| 509 | Bacillales | Paenibacillaceae |
| 510 | Bacillales | Paenibacillaceae |
| 511 | Bacillales | Paenibacillaceae |
| 512 | Bacillales | Paenibacillaceae |
| 513 | Bacillales | Paenibacillaceae |
| 514 | Bacillales | Paenibacillaceae |
| 515 | Bacillales | Paenibacillaceae |
| 516 | Bacillales | Paenibacillaceae |
| 517 | Bacillales | Paenibacillaceae |
| 518 | Bacillales | Paenibacillaceae |
| 519 | Bacillales | Paenibacillaceae |
| 520 | Bacillales | Paenibacillaceae |
| 521 | Bacillales | Paenibacillaceae |
| 522 | Bacillales | Paenibacillaceae |
| 523 | Bacillales | Paenibacillaceae |
| 524 | Bacillales | Paenibacillaceae |
| 525 | Bacillales | Paenibacillaceae |
| 526 | Bacillales | Paenibacillaceae |
| 527 | Bacillales | Paenibacillaceae |
| 528 | Bacillales | Paenibacillaceae |
| 529 | Bacillales | Paenibacillaceae |
| 530 | Bacillales | Paenibacillaceae |
| 531 | Bacillales | Planococcaceae |
| 532 | Bacillales | Planococcaceae |
| 533 | Bacillales | Planococcaceae |
| 534 | Bacillales | Planococcaceae |
| 535 | Bacillales | Planococcaceae |
| 536 | Bacillales | Planococcaceae |
| 537 | Bacillales | Planococcaceae |
| 538 | Bacillales | Sporolactobacillaceae |
| 539 | Bacillales | Staphylococcaceae |
| 540 | Bacillales | Staphylococcaceae |
| 541 | Bacillales | Staphylococcaceae |
| 542 | Bacillales | Staphylococcaceae |
| 543 | Bacillales | Staphylococcaceae |
| 544 | Bacillales | Staphylococcaceae |
| 545 | Bacillales | Staphylococcaceae |
| 546 | Bacillales | Staphylococcaceae |
| 547 | Bacillales | Staphylococcaceae |
| 548 | Bacillales | Staphylococcaceae |
| 549 | Bacillales | Staphylococcaceae |
| 550 | Bacillales | Staphylococcaceae |
| 551 | Bacillales | |
| 552 | Lactobacillales | Aerococcaceae |
| 553 | Lactobacillales | Enterococcaceae |
| 554 | Lactobacillales | Lactobacillaceae |
| 555 | Lactobacillales | Leuconostocaceae |
| 556 | Lactobacillales | Leuconostocaceae |
| 557 | Lactobacillales | Leuconostocaceae |
| 558 | Lactobacillales | Leuconostocaceae |
| 559 | Lactobacillales | Streptococcaceae |
| 560 | Lactobacillales | Streptococcaceae |
| 561 | Lactobacillales | Streptococcaceae |
| 562 | Lactobacillales | Streptococcaceae |
| 563 | Clostridiales | Clostridiaceae |
| 564 | Clostridiales | Clostridiaceae_1 |
| 565 | Clostridiales | Clostridiaceae_1 |

TABLE 17-continued

Phylogeny and OTU designation of the endophytes useful for use in the present invention.

| | | | |
|---|---|---|---|
| 566 | Clostridiales | Clostridiaceae_1 | |
| 567 | Clostridiales | Clostridiaceae_1 | |
| 568 | Clostridiales | Clostridiaceae_1 | |
| 569 | Clostridiales | Clostridiaceae_1 | |
| 570 | Clostridiales | Family_XI | |
| 571 | Clostridiales | Lachnospiraceae | |
| 572 | Clostridiales | Peptostreptococcaceae | |
| 573 | Clostridiales | Peptostreptococcaceae | |
| 574 | Clostridiales | Peptostreptococcaceae | |
| 575 | Clostridiales | Peptostreptococcaceae | |
| 576 | Thermo-anaerobacterales | Carboxydocellaceae | |
| 577 | Thermo-anaerobacterales | Family_III | |
| 578 | Thermo-anaerobacterales | Family_III | |
| 579 | Thermo-anaerobacterales | Family_III | |
| 580 | Thermo-anaerobacterales | Family_III | |
| 581 | Selenomonadales | Veillonellaceae | |
| 582 | Selenomonadales | Veillonellaceae | |
| 583 | Selenomonadales | Veillonellaceae | |
| 584 | Fusobacteriales | Fusobacteriaceae | |
| 585 | Ellin5290 | | |
| 586 | Gemmatimonadales | Gemmatimonadaceae | *Gemmatimonas* |
| 587 | Gemmatimonadales | Gemmatimonadaceae | |
| 588 | Gemmatimonadales | Gemmatimonadaceae | |
| 589 | Gemmatimonadales | Gemmatimonadaceae | |
| 590 | Gemmatimonadales | Gemmatimonadaceae | |
| 591 | Gemmatimonadales | Gemmatimonadaceae | |
| 592 | Gemmatimonadales | Gemmatimonadaceae | |
| 593 | Gemmatimonadales | Gemmatimonadaceae | |
| 594 | Gemmatimonadales | Gemmatimonadaceae | |
| 595 | Gemmatimonadales | Gemmatimonadaceae | |
| 596 | Gemmatimonadales | Gemmatimonadaceae | |
| 597 | Gemmatimonadales | Gemmatimonadaceae | |
| 598 | Gemmatimonadetes | | |
| 599 | | | |
| 600 | WD2101 | | |
| 601 | WD2101_soil_group | | |
| 602 | Planctomycetales | Planctomycetaceae | Candidatus_Nostocoida |
| 603 | Planctomycetales | Planctomycetaceae | *Gemmata* |
| 604 | Planctomycetales | Planctomycetaceae | *Pirellula* |
| 605 | Planctomycetales | Planctomycetaceae | |
| 606 | Planctomycetales | Planctomycetaceae | |
| 607 | Planctomycetales | Planctomycetaceae | |
| 608 | Planctomycetales | Planctomycetaceae | *Planctomyces* |
| 609 | vadinHA49 | | |
| 610 | BD7-3 | | |
| 611 | Caulobacterales | Caulobacteraceae | |
| 612 | Caulobacterales | Caulobacteraceae | |
| 613 | Caulobacterales | Caulobacteraceae | |
| 614 | Caulobacterales | Caulobacteraceae | |
| 615 | Caulobacterales | Caulobacteraceae | |
| 616 | Caulobacterales | Caulobacteraceae | |
| 617 | Caulobacterales | Caulobacteraceae | |
| 618 | Caulobacterales | Caulobacteraceae | |
| 619 | Caulobacterales | Caulobacteraceae | |
| 620 | Caulobacterales | Caulobacteraceae | |
| 621 | Caulobacterales | Caulobacteraceae | |
| 622 | Caulobacterales | Caulobacteraceae | |
| 623 | Caulobacterales | Caulobacteraceae | |
| 624 | Caulobacterales | Caulobacteraceae | |
| 625 | Caulobacterales | Caulobacteraceae | |
| 626 | Caulobacterales | Caulobacteraceae | |
| 627 | Caulobacterales | Caulobacteraceae | |
| 628 | Caulobacterales | Caulobacteraceae | |
| 629 | Caulobacterales | Caulobacteraceae | |
| 630 | Caulobacterales | Caulobacteraceae | |
| 631 | Caulobacterales | Caulobacteraceae | |
| 632 | Caulobacterales | Caulobacteraceae | |
| 633 | Ellin329 | | |
| 634 | Ellin329 | | |
| 635 | Rhizobiales | 1174-901-12 | |
| 636 | Rhizobiales | 1174-901-12 | |
| 637 | Rhizobiales | 1174-901-12 | |
| 638 | Rhizobiales | alphaI_cluster | |

TABLE 17-continued

Phylogeny and OTU designation of the endophytes useful for use in the present invention.

| | | | |
|---|---|---|---|
| 639 | Rhizobiales | Aurantimonadaceae | |
| 640 | Rhizobiales | Aurantimonadaceae | |
| 641 | Rhizobiales | Aurantimonadaceae | |
| 642 | Rhizobiales | Aurantimonadaceae | |
| 643 | Rhizobiales | Aurantimonadaceae | |
| 644 | Rhizobiales | Aurantimonadaceae | |
| 645 | Rhizobiales | Bradyrhizobiaceae | |
| 646 | Rhizobiales | Bradyrhizobiaceae | |
| 647 | Rhizobiales | Bradyrhizobiaceae | |
| 648 | Rhizobiales | Bradyrhizobiaceae | |
| 649 | Rhizobiales | Bradyrhizobiaceae | |
| 650 | Rhizobiales | Bradyrhizobiaceae | |
| 651 | Rhizobiales | Bradyrhizobiaceae | |
| 652 | Rhizobiales | Bradyrhizobiaceae | |
| 653 | Rhizobiales | Bradyrhizobiaceae | |
| 654 | Rhizobiales | Bradyrhizobiaceae | |
| 655 | Rhizobiales | Bradyrhizobiaceae | |
| 656 | Rhizobiales | Bradyrhizobiaceae | |
| 657 | Rhizobiales | Bradyrhizobiaceae | |
| 658 | Rhizobiales | Brucellaceae | |
| 659 | Rhizobiales | F0723 | |
| 660 | Rhizobiales | F0723 | |
| 661 | Rhizobiales | Hyphomicrobiaceae | *Devosia* |
| 662 | Rhizobiales | Hyphomicrobiaceae | *Devosia* |
| 663 | Rhizobiales | Hyphomicrobiaceae | |
| 664 | Rhizobiales | Hyphomicrobiaceae | |
| 665 | Rhizobiales | Hyphomicrobiaceae | |
| 666 | Rhizobiales | Hyphomicrobiaceae | |
| 667 | Rhizobiales | Hyphomicrobiaceae | |
| 668 | Rhizobiales | Hyphomicrobiaceae | |
| 669 | Rhizobiales | Hyphomicrobiaceae | |
| 670 | Rhizobiales | Hyphomicrobiaceae | |
| 671 | Rhizobiales | Hyphomicrobiaceae | |
| 672 | Rhizobiales | Hyphomicrobiaceae | |
| 673 | Rhizobiales | Hyphomicrobiaceae | |
| 674 | Rhizobiales | Hyphomicrobiaceae | |
| 675 | Rhizobiales | Hyphomicrobiaceae | |
| 676 | Rhizobiales | Hyphomicrobiaceae | |
| 677 | Rhizobiales | Hyphomicrobiaceae | |
| 678 | Rhizobiales | Hyphomicrobiaceae | |
| 679 | Rhizobiales | Methylobacteriaceae | |
| 680 | Rhizobiales | Methylobacteriaceae | |
| 681 | Rhizobiales | Methylobacteriaceae | |
| 682 | Rhizobiales | Methylobacteriaceae | |
| 683 | Rhizobiales | Methylobacteriaceae | |
| 684 | Rhizobiales | Methylobacteriaceae | |
| 685 | Rhizobiales | Methylobacteriaceae | |
| 686 | Rhizobiales | Methylobacteriaceae | |
| 687 | Rhizobiales | Methylobacteriaceae | |
| 688 | Rhizobiales | Methylobacteriaceae | |
| 689 | Rhizobiales | Methylobacteriaceae | |
| 690 | Rhizobiales | Methylobacteriaceae | |
| 691 | Rhizobiales | Methylobacteriaceae | |
| 692 | Rhizobiales | Methylobacteriaceae | |
| 693 | Rhizobiales | Methylobacteriaceae | |
| 694 | Rhizobiales | Methylobacteriaceae | |
| 695 | Rhizobiales | Methylobacteriaceae | |
| 696 | Rhizobiales | Methylobacteriaceae | |
| 697 | Rhizobiales | Methylobacteriaceae | |
| 698 | Rhizobiales | Methylobacteriaceae | |
| 699 | Rhizobiales | Methylobacteriaceae | |
| 700 | Rhizobiales | Methylobacteriaceae | |
| 701 | Rhizobiales | Methylobacteriaceae | |
| 702 | Rhizobiales | Methylobacteriaceae | |
| 703 | Rhizobiales | Methylobacteriaceae | |
| 704 | Rhizobiales | Methylobacteriaceae | |
| 705 | Rhizobiales | Methylobacteriaceae | |
| 706 | Rhizobiales | Methylobacteriaceae | |
| 707 | Rhizobiales | Methylobacteriaceae | |
| 708 | Rhizobiales | Methylobacteriaceae | |
| 709 | Rhizobiales | Methylocystaceae | |
| 710 | Rhizobiales | Methylocystaceae | |
| 711 | Rhizobiales | Phyllobacteriaceae | |
| 712 | Rhizobiales | Phyllobacteriaceae | |
| 713 | Rhizobiales | Phyllobacteriaceae | |
| 714 | Rhizobiales | Phyllobacteriaceae | |
| 715 | Rhizobiales | Phyllobacteriaceae | |
| 716 | Rhizobiales | Phyllobacteriaceae | |

TABLE 17-continued

Phylogeny and OTU designation of the endophytes useful for use in the present invention.

| | | | |
|---|---|---|---|
| 717 | Rhizobiales | Rhizobiaceae | |
| 718 | Rhizobiales | Rhizobiaceae | |
| 719 | Rhizobiales | Rhizobiaceae | |
| 720 | Rhizobiales | Rhizobiaceae | |
| 721 | Rhizobiales | Rhizobiaceae | |
| 722 | Rhizobiales | Rhizobiaceae | |
| 723 | Rhizobiales | Rhizobiaceae | |
| 724 | Rhizobiales | Rhizobiaceae | |
| 725 | Rhizobiales | Rhizobiaceae | |
| 726 | Rhizobiales | Rhizobiaceae | |
| 727 | Rhizobiales | Rhizobiaceae | |
| 728 | Rhizobiales | Rhizobiaceae | |
| 729 | Rhizobiales | Rhizobiaceae | |
| 730 | Rhizobiales | Rhizobiaceae | |
| 731 | Rhizobiales | Rhizobiaceae | |
| 732 | Rhizobiales | Rhizobiaceae | |
| 733 | Rhizobiales | Rhizobiaceae | |
| 734 | Rhizobiales | Rhizobiaceae | |
| 735 | Rhizobiales | Rhizobiaceae | |
| 736 | Rhizobiales | Rhizobiaceae | |
| 737 | Rhizobiales | Rhizobiaceae | |
| 738 | Rhizobiales | Rhizobiaceae | |
| 739 | Rhizobiales | Rhizobiaceae | |
| 740 | Rhizobiales | Rhizobiaceae | |
| 741 | Rhizobiales | Rhizobiales_Incertae_Sedis | |
| 742 | Rhizobiales | Rhizobiales_Incertae_Sedis | |
| 743 | Rhizobiales | Rhizobiales_Incertae_Sedis | |
| 744 | Rhizobiales | Rhizobiales_Incertae_Sedis | |
| 745 | Rhizobiales | Rhizobiales_Incertae_Sedis | |
| 746 | Rhizobiales | Rhizobiales_Incertae_Sedis | |
| 747 | Rhizobiales | Rhizobiales_Incertae_Sedis | |
| 748 | Rhizobiales | Xanthobacteraceae | |
| 749 | Rhizobiales | Xanthobacteraceae | |
| 750 | Rhizobiales | Xanthobacteraceae | |
| 751 | Rhizobiales | Xanthobacteraceae | |
| 752 | Rhizobiales | Xanthobacteraceae | |
| 753 | Rhizobiales | Xanthobacteraceae | |
| 754 | Rhizobiales | Xanthobacteraceae | |
| 755 | Rhizobiales | Xanthobacteraceae | |
| 756 | Rhodobacterales | Rhodobacteraceae | |
| 757 | Rhodobacterales | Rhodobacteraceae | |
| 758 | Rhodobacterales | Rhodobacteraceae | |
| 759 | Rhodospirillales | Acetobacteraceae | |
| 760 | Rhodospirillales | Acetobacteraceae | |
| 761 | Rhodospirillales | Acetobacteraceae | |
| 762 | Rhodospirillales | Acetobacteraceae | |
| 763 | Rhodospirillales | Acetobacteraceae | |
| 764 | Rhodospirillales | Acetobacteraceae | |
| 765 | Rhodospirillales | Acetobacteraceae | |
| 766 | Rhodospirillales | Rhodospirillaceae | *Dongia* |
| 767 | Rhodospirillales | Rhodospirillaceae | |
| 768 | Rhodospirillales | Rhodospirillaceae | |
| 769 | Rhodospirillales | Rhodospirillaceae | |
| 770 | Rhodospirillales | Rhodospirillaceae | |
| 771 | Rhodospirillales | Rhodospirillaceae | |
| 772 | Rhodospirillales | Rhodospirillaceae | |
| 773 | Rhodospirillales | Rhodospirillaceae | |
| 774 | Rhodospirillales | Rhodospirillaceae | |
| 775 | Rhodospirillales | Rhodospirillaceae | |
| 776 | Rhodospirillales | Rhodospirillaceae | |
| 777 | Rhodospirillales | Rhodospirillaceae | |
| 778 | Rhodospirillales | Rhodospirillales_Incertae_Sedis | |
| 779 | Rickettsiales | Holosporaceae | |
| 780 | Sphingomonadales | AKYG937 | |
| 781 | Sphingomonadales | Ellin6055 | |
| 782 | Sphingomonadales | Erythrobacteraceae | |
| 783 | Sphingomonadales | Erythrobacteraceae | |
| 784 | Sphingomonadales | Erythrobacteraceae | |
| 785 | Sphingomonadales | Erythrobacteraceae | |
| 786 | Sphingomonadales | Erythrobacteraceae | |

TABLE 17-continued

Phylogeny and OTU designation of the endophytes useful for use in the present invention.

| | | | |
|---|---|---|---|
| 787 | Sphingomonadales | Erythrobacteraceae | |
| 788 | Sphingomonadales | Sphingomonadaceae | *Sphingomonas* |
| 789 | Sphingomonadales | Sphingomonadaceae | |
| 790 | Sphingomonadales | Sphingomonadaceae | |
| 791 | Sphingomonadales | Sphingomonadaceae | |
| 792 | Sphingomonadales | Sphingomonadaceae | |
| 793 | Sphingomonadales | Sphingomonadaceae | |
| 794 | Sphingomonadales | Sphingomonadaceae | |
| 795 | Sphingomonadales | Sphingomonadaceae | |
| 796 | Sphingomonadales | Sphingomonadaceae | |
| 797 | Sphingomonadales | Sphingomonadaceae | |
| 798 | Sphingomonadales | Sphingomonadaceae | |
| 799 | Sphingomonadales | Sphingomonadaceae | |
| 800 | Sphingomonadales | Sphingomonadaceae | |
| 801 | Sphingomonadales | Sphingomonadaceae | |
| 802 | Sphingomonadales | Sphingomonadaceae | |
| 803 | Sphingomonadales | Sphingomonadaceae | |
| 804 | Sphingomonadales | Sphingomonadaceae | |
| 805 | Sphingomonadales | Sphingomonadaceae | |
| 806 | Sphingomonadales | Sphingomonadaceae | |
| 807 | Sphingomonadales | Sphingomonadaceae | |
| 808 | Sphingomonadales | Sphingomonadaceae | |
| 809 | Sphingomonadales | Sphingomonadaceae | |
| 810 | Sphingomonadales | Sphingomonadaceae | |
| 811 | Sphingomonadales | Sphingomonadaceae | |
| 812 | Sphingomonadales | Sphingomonadaceae | |
| 813 | Sphingomonadales | Sphingomonadaceae | |
| 814 | Sphingomonadales | Sphingomonadaceae | |
| 815 | Sphingomonadales | Sphingomonadaceae | |
| 816 | Sphingomonadales | Sphingomonadaceae | |
| 817 | Sphingomonadales | Sphingomonadaceae | |
| 818 | Sphingomonadales | Sphingomonadaceae | |
| 819 | Sphingomonadales | Sphingomonadaceae | |
| 820 | Sphingomonadales | Sphingomonadaceae | |
| 821 | Sphingomonadales | Sphingomonadaceae | |
| 822 | Sphingomonadales | Sphingomonadaceae | |
| 823 | Sphingomonadales | Sphingomonadaceae | |
| 824 | Sphingomonadales | Sphingomonadaceae | |
| 825 | Sphingomonadales | Sphingomonadaceae | |
| 826 | Sphingomonadales | Sphingomonadaceae | |
| 827 | Sphingomonadales | Sphingomonadaceae | |
| 828 | Sphingomonadales | Sphingomonadaceae | |
| 829 | Sphingomonadales | Sphingomonadaceae | |
| 830 | Sphingomonadales | Sphingomonadaceae | |
| 831 | Sphingomonadales | Sphingomonadaceae | |
| 832 | Sphingomonadales | Sphingomonadaceae | |
| 833 | Sphingomonadales | Sphingomonadaceae | |
| 834 | Sphingomonadales | Sphingomonadaceae | |
| 835 | Sphingomonadales | Sphingomonadaceae | |
| 836 | Sphingomonadales | Sphingomonadaceae | |
| 837 | Sphingomonadales | Sphingomonadaceae | |
| 838 | Sphingomonadales | Sphingomonadaceae | |
| 839 | Sphingomonadales | Sphingomonadaceae | |
| 840 | Sphingomonadales | Sphingomonadaceae | |
| 841 | Sphingomonadales | Sphingomonadaceae | |
| 842 | Sphingomonadales | Sphingomonadaceae | |
| 843 | Sphingomonadales | Sphingomonadaceae | |
| 844 | Sphingomonadales | Sphingomonadaceae | |
| 845 | Sphingomonadales | Sphingomonadaceae | |
| 846 | Sphingomonadales | Sphingomonadaceae | |
| 847 | Sphingomonadales | Sphingomonadaceae | |
| 848 | Sphingomonadales | Sphingomonadaceae | |
| 849 | Sphingomonadales | Sphingomonadaceae | |
| 850 | Sphingomonadales | Sphingomonadaceae | |
| 851 | Sphingomonadales | Sphingomonadaceae | |
| 852 | Sphingomonadales | Sphingomonadaceae | |
| 853 | Sphingomonadales | Sphingomonadaceae | |
| 854 | Sphingomonadales | Sphingomonadaceae | |
| 855 | Sphingomonadales | Sphingomonadaceae | |
| 856 | Sphingomonadales | Sphingomonadaceae | |
| 857 | Sphingomonadales | Sphingomonadaceae | |
| 858 | Sphingomonadales | Sphingomonadaceae | |
| 859 | Sphingomonadales | Sphingomonadaceae | |
| 860 | Sphingomonadales | | |
| 861 | Sphingomonadales | | |
| 862 | Alphaproteobacteria | | |
| 863 | Burkholderiales | Alcaligenaceae | |
| 864 | Burkholderiales | Alcaligenaceae | |

TABLE 17-continued

Phylogeny and OTU designation of the endophytes useful for use in the present invention.

| | | | |
|---|---|---|---|
| 865 | Burkholderiales | Alcaligenaceae | |
| 866 | Burkholderiales | Burkholderiaceae | |
| 867 | Burkholderiales | Burkholderiaceae | |
| 868 | Burkholderiales | Burkholderiaceae | |
| 869 | Burkholderiales | Burkholderiaceae | |
| 870 | Burkholderiales | Burkholderiaceae | |
| 871 | Burkholderiales | Burkholderiaceae | |
| 872 | Burkholderiales | Burkholderiaceae | |
| 873 | Burkholderiales | Burkholderiaceae | |
| 874 | Burkholderiales | Burkholderiaceae | |
| 875 | Burkholderiales | Burkholderiaceae | |
| 876 | Burkholderiales | Burkholderiaceae | |
| 877 | Burkholderiales | Burkholderiaceae | |
| 878 | Burkholderiales | Burkholderiaceae | |
| 879 | Burkholderiales | Burkholderiaceae | |
| 880 | Burkholderiales | Burkholderiaceae | |
| 881 | Burkholderiales | Burkholderiaceae | |
| 882 | Burkholderiales | Burkholderiaceae | |
| 883 | Burkholderiales | Burkholderiaceae | |
| 884 | Burkholderiales | Burkholderiaceae | |
| 885 | Burkholderiales | Burkholderiaceae | |
| 886 | Burkholderiales | Burkholderiaceae | |
| 887 | Burkholderiales | Burkholderiaceae | |
| 888 | Burkholderiales | Burkholderiaceae | |
| 889 | Burkholderiales | Burkholderiaceae | |
| 890 | Burkholderiales | Burkholderiaceae | |
| 891 | Burkholderiales | Comamonadaceae | *Acidovorax* |
| 892 | Burkholderiales | Comamonadaceae | |
| 893 | Burkholderiales | Comamonadaceae | |
| 894 | Burkholderiales | Comamonadaceae | |
| 895 | Burkholderiales | Comamonadaceae | |
| 896 | Burkholderiales | Comamonadaceae | |
| 897 | Burkholderiales | Comamonadaceae | |
| 898 | Burkholderiales | Comamonadaceae | |
| 899 | Burkholderiales | Comamonadaceae | |
| 900 | Burkholderiales | Comamonadaceae | |
| 901 | Burkholderiales | Comamonadaceae | |
| 902 | Burkholderiales | Comamonadaceae | |
| 903 | Burkholderiales | Comamonadaceae | |
| 904 | Burkholderiales | Comamonadaceae | |
| 905 | Burkholderiales | Comamonadaceae | |
| 906 | Burkholderiales | Comamonadaceae | |
| 907 | Burkholderiales | Comamonadaceae | |
| 908 | Burkholderiales | Comamonadaceae | |
| 909 | Burkholderiales | Comamonadaceae | |
| 910 | Burkholderiales | Comamonadaceae | |
| 911 | Burkholderiales | Comamonadaceae | |
| 912 | Burkholderiales | Comamonadaceae | |
| 913 | Burkholderiales | Comamonadaceae | |
| 914 | Burkholderiales | Comamonadaceae | |
| 915 | Burkholderiales | Comamonadaceae | |
| 916 | Burkholderiales | Comamonadaceae | |
| 917 | Burkholderiales | Comamonadaceae | |
| 918 | Burkholderiales | Comamonadaceae | |
| 919 | Burkholderiales | Comamonadaceae | |
| 920 | Burkholderiales | Comamonadaceae | |
| 921 | Burkholderiales | Comamonadaceae | |
| 922 | Burkholderiales | Comamonadaceae | |
| 923 | Burkholderiales | Comamonadaceae | |
| 924 | Burkholderiales | Comamonadaceae | |
| 925 | Burkholderiales | Comamonadaceae | |
| 926 | Burkholderiales | Comamonadaceae | |
| 927 | Burkholderiales | Comamonadaceae | |
| 928 | Burkholderiales | Comamonadaceae | |
| 929 | Burkholderiales | Comamonadaceae | |
| 930 | Burkholderiales | Comamonadaceae | |
| 931 | Burkholderiales | Comamonadaceae | |
| 932 | Burkholderiales | Comamonadaceae | |
| 933 | Burkholderiales | Comamonadaceae | |
| 934 | Burkholderiales | Comamonadaceae | |
| 935 | Burkholderiales | Comamonadaceae | |
| 936 | Burkholderiales | Comamonadaceae | |
| 937 | Burkholderiales | Comamonadaceae | |
| 938 | Burkholderiales | Comamonadaceae | |
| 939 | Burkholderiales | Comamonadaceae | |
| 940 | Burkholderiales | Comamonadaceae | |
| 941 | Burkholderiales | Comamonadaceae | |
| 942 | Burkholderiales | Comamonadaceae | |

TABLE 17-continued

Phylogeny and OTU designation of the endophytes useful for use in the present invention.

| | | | |
|---|---|---|---|
| 943 | Burkholderiales | Comamonadaceae | |
| 944 | Burkholderiales | Comamonadaceae | |
| 945 | Burkholderiales | Comamonadaceae | |
| 946 | Burkholderiales | Comamonadaceae | |
| 947 | Burkholderiales | Comamonadaceae | |
| 948 | Burkholderiales | Comamonadaceae | |
| 949 | Burkholderiales | Comamonadaceae | |
| 950 | Burkholderiales | Comamonadaceae | |
| 951 | Burkholderiales | Comamonadaceae | |
| 952 | Burkholderiales | Comamonadaceae | |
| 953 | Burkholderiales | Comamonadaceae | |
| 954 | Burkholderiales | Comamonadaceae | |
| 955 | Burkholderiales | Oxalobacteraceae | *Massilia* |
| 956 | Burkholderiales | Oxalobacteraceae | *Massilia* |
| 957 | Burkholderiales | Oxalobacteraceae | |
| 958 | Burkholderiales | Oxalobacteraceae | |
| 959 | Burkholderiales | Oxalobacteraceae | |
| 960 | Burkholderiales | Oxalobacteraceae | |
| 961 | Burkholderiales | Oxalobacteraceae | |
| 962 | Burkholderiales | Oxalobacteraceae | |
| 963 | Burkholderiales | Oxalobacteraceae | |
| 964 | Burkholderiales | Oxalobacteraceae | |
| 965 | Burkholderiales | Oxalobacteraceae | |
| 966 | Burkholderiales | Oxalobacteraceae | |
| 967 | Burkholderiales | Oxalobacteraceae | |
| 968 | Burkholderiales | Oxalobacteraceae | |
| 969 | Burkholderiales | Oxalobacteraceae | |
| 970 | Burkholderiales | Oxalobacteraceae | |
| 971 | Burkholderiales | Oxalobacteraceae | |
| 972 | Burkholderiales | Oxalobacteraceae | |
| 973 | Burkholderiales | Oxalobacteraceae | |
| 974 | Burkholderiales | Oxalobacteraceae | |
| 975 | Burkholderiales | Oxalobacteraceae | |
| 976 | Burkholderiales | Oxalobacteraceae | |
| 977 | Burkholderiales | Oxalobacteraceae | |
| 978 | Burkholderiales | Oxalobacteraceae | |
| 979 | Burkholderiales | Oxalobacteraceae | |
| 980 | Burkholderiales | Oxalobacteraceae | |
| 981 | Burkholderiales | Oxalobacteraceae | |
| 982 | Burkholderiales | Oxalobacteraceae | |
| 983 | Burkholderiales | Oxalobacteraceae | |
| 984 | Burkholderiales | Oxalobacteraceae | |
| 985 | Burkholderiales | Oxalobacteraceae | |
| 986 | Burkholderiales | Oxalobacteraceae | |
| 987 | Burkholderiales | Oxalobacteraceae | |
| 988 | Burkholderiales | Oxalobacteraceae | |
| 989 | Burkholderiales | Oxalobacteraceae | |
| 990 | Burkholderiales | Oxalobacteraceae | |
| 991 | Burkholderiales | Oxalobacteraceae | |
| 992 | Burkholderiales | Oxalobacteraceae | |
| 993 | Burkholderiales | Oxalobacteraceae | |
| 994 | Burkholderiales | Oxalobacteraceae | |
| 995 | Burkholderiales | Oxalobacteraceae | |
| 996 | Burkholderiales | Oxalobacteraceae | |
| 997 | Burkholderiales | Oxalobacteraceae | |
| 998 | Burkholderiales | Oxalobacteraceae | |
| 999 | Burkholderiales | Oxalobacteraceae | |
| 1000 | Burkholderiales | Oxalobacteraceae | |
| 1001 | Burkholderiales | Oxalobacteraceae | |
| 1002 | Burkholderiales | Oxalobacteraceae | |
| 1003 | Burkholderiales | Oxalobacteraceae | |
| 1004 | Burkholderiales | Oxalobacteraceae | |
| 1005 | Burkholderiales | Oxalobacteraceae | |
| 1006 | Burkholderiales | Oxalobacteraceae | |
| 1007 | Burkholderiales | Oxalobacteraceae | |
| 1008 | Burkholderiales | Oxalobacteraceae | |
| 1009 | Burkholderiales | Oxalobacteraceae | |
| 1010 | Burkholderiales | Oxalobacteraceae | |
| 1011 | Burkholderiales | Oxalobacteraceae | |
| 1012 | Burkholderiales | Oxalobacteraceae | |
| 1013 | Burkholderiales | Oxalobacteraceae | |
| 1014 | Burkholderiales | Oxalobacteraceae | |
| 1015 | Methylophilales | Methylophilaceae | |
| 1016 | Methylophilales | Methylophilaceae | |
| 1017 | Methylophilales | Methylophilaceae | |
| 1018 | Methylophilales | Methylophilaceae | |
| 1019 | Methylophilales | Methylophilaceae | |
| 1020 | Methylophilales | Methylophilaceae | |

TABLE 17-continued

Phylogeny and OTU designation of the endophytes useful for use in the present invention.

| | | | |
|---|---|---|---|
| 1021 | Methylophilales | Methylophilaceae | |
| 1022 | Methylophilales | Methylophilaceae | |
| 1023 | Neisseriales | Neisseriaceae | |
| 1024 | Nitro somonadales | Nitrosomonadaceae | |
| 1025 | Nitro somonadales | Nitrosomonadaceae | |
| 1026 | Nitro somonadales | Nitrosomonadaceae | |
| 1027 | Nitro somonadales | Nitrosomonadaceae | |
| 1028 | Nitro somonadales | Nitrosomonadaceae | |
| 1029 | Nitro somonadales | Nitrosomonadaceae | |
| 1030 | TRA3-20 | | |
| 1031 | TRA3-20 | | |
| 1032 | TRA3-20 | | |
| 1033 | Bdellovibrionales | Bacteriovoracaceae | *Bacteriovorax* |
| 1034 | Bdellovibrionales | Bacteriovoracaceae | *Bacteriovorax* |
| 1035 | Bdellovibrionales | Bacteriovoracaceae | |
| 1036 | Bdellovibrionales | Bacteriovoracaceae | |
| 1037 | Bdellovibrionales | Bdellovibrionaceae | *Bdellovibrio* |
| 1038 | Bdellovibrionales | Bdellovibrionaceae | *Bdellovibrio* |
| 1039 | Bdellovibrionales | Bdellovibrionaceae | |
| 1040 | Bdellovibrionales | Bdellovibrionaceae | |
| 1041 | Desulfuromonadales | GR-WP33-58 | |
| 1042 | GR-WP33-30 | | |
| 1043 | GR-WP33-30 | | |
| 1044 | GR-WP33-30 | | |
| 1045 | Myxococcales | 0319-6G20 | |
| 1046 | Myxococcales | 0319-6G20 | |
| 1047 | Myxococcales | 0319-6G20 | |
| 1048 | Myxococcales | 0319-6G20 | |
| 1049 | Myxococcales | Haliangiaceae | *Haliangium* |
| 1050 | Myxococcales | Haliangiaceae | |
| 1051 | Myxococcales | Haliangiaceae | |
| 1052 | Myxococcales | Haliangiaceae | |
| 1053 | Myxococcales | Myxococcaceae | *Corallococcus* |
| 1054 | Myxococcales | Polyangiaceae | |
| 1055 | Myxococcales | Sandaracinaceae | |
| 1056 | Myxococcales | Sandaracinaceae | |
| 1057 | Myxococcales | | |
| 1058 | Myxococcales | | |
| 1059 | Myxococcales | | |
| 1060 | Myxococcales | | |
| 1061 | Myxococcales | | |
| 1062 | Myxococcales | | |
| 1063 | Myxococcales | | |
| 1064 | Myxococcales | | |
| 1065 | Myxococcales | | |
| 1066 | Myxococcales | | |
| 1067 | Myxococcales | | |
| 1068 | Myxococcales | | |
| 1069 | Myxococcales | | |
| 1070 | Myxococcales | | |
| 1071 | Sh765B-TzT-29 | | |
| 1072 | Spirobacillales | | |
| 1073 | Syntrophobacterales | Syntrophobacteraceae | |
| 1074 | Alteromonadales | Alteromonadaceae | |
| 1075 | Alteromonadales | Shewanellaceae | |
| 1076 | Chromatiales | Chromatiaceae | |
| 1077 | Enterobacteriales | Enterobacteriaceae | |
| 1078 | Enterobacteriales | Enterobacteriaceae | |
| 1079 | Enterobacteriales | Enterobacteriaceae | |
| 1080 | Enterobacteriales | Enterobacteriaceae | |
| 1081 | Enterobacteriales | Enterobacteriaceae | |
| 1082 | Enterobacteriales | Enterobacteriaceae | |
| 1083 | Enterobacteriales | Enterobacteriaceae | |
| 1084 | Enterobacteriales | Enterobacteriaceae | |
| 1085 | Enterobacteriales | Enterobacteriaceae | |
| 1086 | Enterobacteriales | Enterobacteriaceae | |
| 1087 | Enterobacteriales | Enterobacteriaceae | |
| 1088 | Enterobacteriales | Enterobacteriaceae | |
| 1089 | Enterobacteriales | Enterobacteriaceae | |
| 1090 | Enterobacteriales | Enterobacteriaceae | |
| 1091 | Enterobacteriales | Enterobacteriaceae | |
| 1092 | Enterobacteriales | Enterobacteriaceae | |
| 1093 | Enterobacteriales | Enterobacteriaceae | |
| 1094 | Enterobacteriales | Enterobacteriaceae | |
| 1095 | Enterobacteriales | Enterobacteriaceae | |
| 1096 | Enterobacteriales | Enterobacteriaceae | |
| 1097 | Enterobacteriales | Enterobacteriaceae | |
| 1098 | Enterobacteriales | Enterobacteriaceae | |

TABLE 17-continued

Phylogeny and OTU designation of the endophytes useful for use in the present invention.

| | | | |
|---|---|---|---|
| 1099 | Enterobacteriales | Enterobacteriaceae | |
| 1100 | Enterobacteriales | Enterobacteriaceae | |
| 1101 | Enterobacteriales | Enterobacteriaceae | |
| 1102 | Enterobacteriales | Enterobacteriaceae | |
| 1103 | Enterobacteriales | Enterobacteriaceae | |
| 1104 | Enterobacteriales | Enterobacteriaceae | |
| 1105 | Enterobacteriales | Enterobacteriaceae | |
| 1106 | Enterobacteriales | Enterobacteriaceae | |
| 1107 | Enterobacteriales | Enterobacteriaceae | |
| 1108 | Enterobacteriales | Enterobacteriaceae | |
| 1109 | Enterobacteriales | Enterobacteriaceae | |
| 1110 | Enterobacteriales | Enterobacteriaceae | |
| 1111 | Enterobacteriales | Enterobacteriaceae | |
| 1112 | Enterobacteriales | Enterobacteriaceae | |
| 1113 | Enterobacteriales | Enterobacteriaceae | |
| 1114 | Legionellales | Coxiellaceae | *Aquicella* |
| 1115 | Legionellales | Coxiellaceae | *Aquicella* |
| 1116 | Legionellales | Coxiellaceae | *Aquicella* |
| 1117 | Legionellales | Coxiellaceae | *Aquicella* |
| 1118 | Legionellales | Coxiellaceae | *Aquicella* |
| 1119 | Legionellales | Coxiellaceae | |
| 1120 | Legionellales | Coxiellaceae | |
| 1121 | Legionellales | Coxiellaceae | |
| 1122 | Legionellales | Coxiellaceae | |
| 1123 | Legionellales | Coxiellaceae | |
| 1124 | Legionellales | Coxiellaceae | |
| 1125 | Legionellales | Coxiellaceae | |
| 1126 | Legionellales | Coxiellaceae | |
| 1127 | Legionellales | Coxiellaceae | |
| 1128 | Legionellales | Coxiellaceae | |
| 1129 | Legionellales | Coxiellaceae | |
| 1130 | Legionellales | Coxiellaceae | |
| 1131 | Legionellales | Coxiellaceae | |
| 1132 | Legionellales | Legionellaceae | |
| 1133 | Legionellales | | |
| 1134 | Oceanospirillales | Halomonadaceae | |
| 1135 | Oceanospirillales | Oceanospirillaceae | *Pseudospirillum* |
| 1136 | Oceanospirillales | Oceanospirillaceae | |
| 1137 | Oceanospirillales | Oceanospirillaceae | |
| 1138 | Oceanospirillales | Oceanospirillaceae | |
| 1139 | Pasteurellales | Pasteurellaceae | |
| 1140 | Pasteurellales | Pasteurellaceae | |
| 1141 | Pasteurellales | Pasteurellaceae | |
| 1142 | Pasteurellales | Pasteurellaceae | |
| 1143 | Pseudomonadales | Moraxellaceae | |
| 1144 | Pseudomonadales | Moraxellaceae | |
| 1145 | Pseudomonadales | Moraxellaceae | |
| 1146 | Pseudomonadales | Moraxellaceae | |
| 1147 | Pseudomonadales | Moraxellaceae | |
| 1148 | Pseudomonadales | Moraxellaceae | |
| 1149 | Pseudomonadales | Moraxellaceae | |
| 1150 | Pseudomonadales | Moraxellaceae | |
| 1151 | Pseudomonadales | Moraxellaceae | |
| 1152 | Pseudomonadales | Moraxellaceae | |
| 1153 | Pseudomonadales | Moraxellaceae | |
| 1154 | Pseudomonadales | Pseudomonadaceae | |
| 1155 | Pseudomonadales | Pseudomonadaceae | |
| 1156 | Pseudomonadales | Pseudomonadaceae | |
| 1157 | Pseudomonadales | Pseudomonadaceae | |
| 1158 | Pseudomonadales | Pseudomonadaceae | |
| 1159 | Pseudomonadales | Pseudomonadaceae | |
| 1160 | Pseudomonadales | Pseudomonadaceae | |
| 1161 | Pseudomonadales | Pseudomonadaceae | |
| 1162 | Pseudomonadales | Pseudomonadaceae | |
| 1163 | Pseudomonadales | Pseudomonadaceae | |
| 1164 | Pseudomonadales | Pseudomonadaceae | |
| 1165 | Pseudomonadales | Pseudomonadaceae | |
| 1166 | Pseudomonadales | Pseudomonadaceae | |
| 1167 | Pseudomonadales | Pseudomonadaceae | |
| 1168 | Pseudomonadales | Pseudomonadaceae | |
| 1169 | Pseudomonadales | Pseudomonadaceae | |
| 1170 | Pseudomonadales | Pseudomonadaceae | |
| 1171 | Pseudomonadales | Pseudomonadaceae | |
| 1172 | Pseudomonadales | Pseudomonadaceae | |
| 1173 | Pseudomonadales | Pseudomonadaceae | |
| 1174 | Pseudomonadales | Pseudomonadaceae | |
| 1175 | Pseudomonadales | Pseudomonadaceae | |
| 1176 | Pseudomonadales | Pseudomonadaceae | |

TABLE 17-continued

Phylogeny and OTU designation of the endophytes useful for use in the present invention.

| | | | |
|---|---|---|---|
| 1177 | Pseudomonadales | Pseudomonadaceae | |
| 1178 | Pseudomonadales | Pseudomonadaceae | |
| 1179 | Pseudomonadales | Pseudomonadaceae | |
| 1180 | Pseudomonadales | Pseudomonadaceae | |
| 1181 | Pseudomonadales | Pseudomonadaceae | |
| 1182 | Pseudomonadales | Pseudomonadaceae | |
| 1183 | Pseudomonadales | Pseudomonadaceae | |
| 1184 | Pseudomonadales | Pseudomonadaceae | |
| 1185 | Pseudomonadales | Pseudomonadaceae | |
| 1186 | Pseudomonadales | Pseudomonadaceae | |
| 1187 | Pseudomonadales | Pseudomonadaceae | |
| 1188 | Pseudomonadales | Pseudomonadaceae | |
| 1189 | Pseudomonadales | Pseudomonadaceae | |
| 1190 | Pseudomonadales | Pseudomonadaceae | |
| 1191 | Pseudomonadales | Pseudomonadaceae | |
| 1192 | Pseudomonadales | Pseudomonadaceae | |
| 1193 | Pseudomonadales | Pseudomonadaceae | |
| 1194 | Pseudomonadales | Pseudomonadaceae | |
| 1195 | Pseudomonadales | Pseudomonadaceae | |
| 1196 | Pseudomonadales | Pseudomonadaceae | |
| 1197 | Pseudomonadales | Pseudomonadaceae | |
| 1198 | Pseudomonadales | Pseudomonadaceae | |
| 1199 | Pseudomonadales | Pseudomonadaceae | |
| 1200 | Pseudomonadales | Pseudomonadaceae | |
| 1201 | Pseudomonadales | Pseudomonadaceae | |
| 1202 | Pseudomonadales | Pseudomonadaceae | |
| 1203 | Thiotrichales | Piscirickettsiaceae | |
| 1204 | Xanthomonadales | Sinobacteraceae | |
| 1205 | Xanthomonadales | Sinobacteraceae | |
| 1206 | Xanthomonadales | Solimonadaceae | *Fontimonas* |
| 1207 | Xanthomonadales | Solimonadaceae | |
| 1208 | Xanthomonadales | Xanthomonadaceae | *Stenotrophomonas* |
| 1209 | Xanthomonadales | Xanthomonadaceae | |
| 1210 | Xanthomonadales | Xanthomonadaceae | |
| 1211 | Xanthomonadales | Xanthomonadaceae | |
| 1212 | Xanthomonadales | Xanthomonadaceae | |
| 1213 | Xanthomonadales | Xanthomonadaceae | |
| 1214 | Xanthomonadales | Xanthomonadaceae | |
| 1215 | Xanthomonadales | Xanthomonadaceae | |
| 1216 | Xanthomonadales | Xanthomonadaceae | |
| 1217 | Xanthomonadales | Xanthomonadaceae | |
| 1218 | Xanthomonadales | Xanthomonadaceae | |
| 1219 | Xanthomonadales | Xanthomonadaceae | |
| 1220 | Xanthomonadales | Xanthomonadaceae | |
| 1221 | Xanthomonadales | Xanthomonadaceae | |
| 1222 | Xanthomonadales | Xanthomonadaceae | |
| 1223 | Xanthomonadales | Xanthomonadaceae | |
| 1224 | Xanthomonadales | Xanthomonadaceae | |
| 1225 | Xanthomonadales | Xanthomonadaceae | |
| 1226 | Xanthomonadales | Xanthomonadaceae | |
| 1227 | Xanthomonadales | Xanthomonadaceae | |
| 1228 | Xanthomonadales | Xanthomonadaceae | |
| 1229 | Xanthomonadales | Xanthomonadaceae | |
| 1230 | Xanthomonadales | Xanthomonadaceae | |
| 1231 | Xanthomonadales | Xanthomonadaceae | |
| 1232 | Xanthomonadales | Xanthomonadaceae | |
| 1233 | Xanthomonadales | Xanthomonadaceae | |
| 1234 | Xanthomonadales | Xanthomonadaceae | |
| 1235 | Xanthomonadales | Xanthomonadaceae | |
| 1236 | Xanthomonadales | Xanthomonadaceae | |
| 1237 | Xanthomonadales | Xanthomonadaceae | |
| 1238 | Xanthomonadales | Xanthomonadaceae | |
| 1239 | Xanthomonadales | Xanthomonadaceae | |
| 1240 | Xanthomonadales | Xanthomonadaceae | |
| 1241 | Xanthomonadales | Xanthomonadaceae | |
| 1242 | Xanthomonadales | Xanthomonadaceae | |
| 1243 | Xanthomonadales | Xanthomonadaceae | |
| 1244 | Xanthomonadales | Xanthomonadaceae | |
| 1245 | Xanthomonadales | Xanthomonadaceae | |
| 1246 | Xanthomonadales | Xanthomonadaceae | |
| 1247 | Xanthomonadales | Xanthomonadaceae | |
| 1248 | Xanthomonadales | Xanthomonadaceae | |
| 1249 | Xanthomonadales | Xanthomonadales_Incertae_Sedis | |
| 1250 | Xanthomonadales | Xanthomonadales_Incertae_Sedis | |
| 1251 | Xanthomonadales | Xanthomonadales_Incertae_Sedis | |

TABLE 17-continued

Phylogeny and OTU designation of the endophytes useful for use in the present invention.

| | | | |
|---|---|---|---|
| 1252 | Xanthomonadales | | |
| 1253 | Xanthomonadales | | |
| 1254 | Xanthomonadales | | |
| 1255 | Xanthomonadales | | |
| 1256 | Xanthomonadales | | |
| 1257 | Xanthomonadales | | |
| 1258 | Xanthomonadales | | |
| 1259 | Xanthomonadales | | |
| 1260 | Xanthomonadales | | |
| 1261 | Spirochaetales | Leptospiraceae | |
| 1262 | Entomoplasmatales | Spiroplasmataceae | |
| 1263 | Mollicutes_Incertae_Sedis | Unknown_Family | |
| 1264 | Mollicutes_Incertae_Sedis | Unknown_Family | |
| 1265 | Mycoplasmatales | Mycoplasmataceae | |
| 1266 | Mycoplasmatales | Mycoplasmataceae | |
| 1267 | Deinococcales | Deinococcaceae | *Deinococcus* |
| 1268 | | | |
| 1269 | | | |
| 1270 | | | |
| 1271 | | | |
| 1272 | | | |
| 1273 | | | |
| 1274 | | | |
| 1275 | OPB35_soil_group | | |
| 1276 | OPB35_soil_group | | |
| 1277 | OPB35_soil_group | | |
| 1278 | OPB35_soil_group | | |
| 1279 | OPB35_soil_group | | |
| 1280 | OPB35_soil_group | | |
| 1281 | OPB35_soil_group | | |
| 1282 | OPB35_soil_group | | |
| 1283 | OPB35_soil_group | | |
| 1284 | OPB35_soil_group | | |
| 1285 | OPB35_soil_group | | |
| 1286 | Opitutales | Opitutaceae | *Opitutus* |
| 1287 | Opitutales | Opitutaceae | *Opitutus* |
| 1288 | Opitutales | Opitutaceae | |
| 1289 | Opitutales | Opitutaceae | |
| 1290 | Opitutales | Opitutaceae | |
| 1291 | Opitutales | Opitutaceae | |
| 1292 | Opitutales | Opitutaceae | |
| 1293 | Opitutales | Opitutaceae | |
| 1294 | Opitutales | Opitutaceae | |
| 1295 | Opitutales | Opitutaceae | |
| 1296 | Opitutales | Opitutaceae | |
| 1297 | Opitutales | Opitutaceae | |
| 1298 | Pedosphaerales | | |
| 1299 | Chthoniobacterales | Chthoniobacteraceae | *Chthoniobacter* |
| 1300 | Chthoniobacterales | Chthoniobacteraceae | *Chthoniobacter* |
| 1301 | Chthoniobacterales | Chthoniobacteraceae | |
| 1302 | Chthoniobacterales | Chthoniobacteraceae | |
| 1303 | Chthoniobacterales | Chthoniobacteraceae | |
| 1304 | Chthoniobacterales | DA101_soil_group | |
| 1305 | Chthoniobacterales | DA101_soil_group | |
| 1306 | Chthoniobacterales | DA101_soil_group | |
| 1307 | Chthoniobacterales | DA101_soil_group | |
| 1308 | Chthoniobacterales | DA101_soil_group | |
| 1309 | Chthoniobacterales | DA101_soil_group | |
| 1310 | Verrucomicrobiales | Verrucomicrobiaceae | *Brevifollis* |
| 1311 | Verrucomicrobiales | Verrucomicrobiaceae | *Haloferula* |
| 1312 | Verrucomicrobiales | Verrucomicrobiaceae | *Luteolibacter* |
| 1313 | Verrucomicrobiales | Verrucomicrobiaceae | |
| 1314 | Verrucomicrobiales | Verrucomicrobiaceae | |
| 1315 | Verrucomicrobiales | Verrucomicrobiaceae | |
| 1316 | Verrucomicrobiales | Verrucomicrobiaceae | |
| 1317 | Verrucomicrobiales | Verrucomicrobiaceae | |
| 1318 | Verrucomicrobiales | Verrucomicrobiaceae | |
| 1319 | | | |
| 1320 | | | |
| 1321 | | | |
| 1322 | | | |
| 1323 | | | |
| 1324 | | | |
| 1325 | | | |
| 1326 | | | |
| 1327 | | | |

TABLE 17-continued

Phylogeny and OTU designation of the endophytes useful for use in the present invention.

1328
1329
1330
1331
1332
1333
1334
1335
1336
1337
1338
1339
1340
1341
1342
1343
1344
1345
1346
1347
1348
1349
1350
1351
1352
1353
1354
1355
1356
1357
1358
1359
1360
1361
1362
1363
1364
1365
1366
1367
1368
1369
1370
1371
1372
1373
1374
1375
1376
1377
1378
1379
1380
1381
1382
1383
1384
1385
1386
1387
1388
1389
1390
1391
1392
1393
1394
1395
1396
1397
1398
1399
1400
1401
1402
1403
1404
1405

TABLE 17-continued

Phylogeny and OTU designation of the endophytes useful for use in the present invention.

| | | |
|---|---|---|
| 1406 | | |
| 1407 | | |
| 1408 | | |
| 1409 | | |
| 1410 | | |
| 1411 | | |
| 1412 | | |
| 1413 | | |
| 1414 | | |
| 1415 | | |
| 1416 | | |
| 1417 | | |
| 1418 | | |
| 1419 | | |
| 1420 | | |
| 1421 | | |
| 1422 | | |
| 1423 | | |
| 1424 | | |
| 1425 | | |
| 1426 | | |
| 1427 | | |
| 1428 | | |
| 1429 | | |
| 1430 | | |
| 1431 | | |
| 1432 | | |
| 1433 | | |
| 1434 | | |
| 1435 | | |
| 1436 | | |
| 1437 | | |
| 1438 | | |
| 1439 | | |
| 1440 | | |
| 1441 | | |
| 1442 | | |
| 1443 | | |
| 1444 | | |
| 1445 | | |
| 1446 | | |
| 1447 | | |
| 1448 | | |
| 1449 | | |
| 1450 | | |
| 1451 | | |
| 1452 | | |
| 1453 | | |
| 1454 | | |
| 1455 | | |
| 1456 | | |
| 1457 | | |
| 1458 | | |
| 1459 | | |
| 1460 | | |
| 1461 | | |
| 1462 | | |
| 1463 | | |
| 1464 | | |
| 1465 | | |
| 1466 | | |
| 1467 | | |
| 1468 | | |
| 1469 | | |
| 1470 | | |
| 1471 | | |
| 1472 | | |
| 1473 | | |
| 1474 | | |
| 1475 | | |
| 1476 | | |
| 1477 | Hypocreales | Nectriaceae |
| 1478 | Capnodiales | Davidiellaceae |
| 1479 | Capnodiales | Davidiellaceae |
| 1480 | Capnodiales | Davidiellaceae |
| 1481 | Capnodiales | Davidiellaceae |
| 1482 | Capnodiales | Davidiellaceae |
| 1483 | Capnodiales | Davidiellaceae |

TABLE 17-continued

Phylogeny and OTU designation of the endophytes useful for use in the present invention.

| | | | |
|---|---|---|---|
| 1484 | Capnodiales | Mycosphaerellaceae | |
| 1485 | Capnodiales | Mycosphaerellaceae | |
| 1486 | Dothideales | Dothioraceae | |
| 1487 | Dothideales | Dothioraceae | |
| 1488 | Dothideales | Dothioraceae | |
| 1489 | Dothideales | Dothioraceae | |
| 1490 | Incertae sedis | Pseudeurotiaceae | |
| 1491 | Incertae sedis | Pseudeurotiaceae | |
| 1492 | Pleosporales | Incertae sedis | *Phoma* |
| 1493 | Pleosporales | Incertae sedis | |
| 1494 | Pleosporales | Leptosphaeriaceae | |
| 1495 | Pleosporales | Leptosphaeriaceae | |
| 1496 | Pleosporales | Montagnulaceae | |
| 1497 | Pleosporales | Montagnulaceae | |
| 1498 | Pleosporales | Phaeosphaeriaceae | |
| 1499 | Pleosporales | Phaeosphaeriaceae | |
| 1500 | Pleosporales | Phaeosphaeriaceae | |
| 1501 | Pleosporales | Phaeosphaeriaceae | |
| 1502 | Pleosporales | Pleosporaceae | |
| 1503 | Pleosporales | Pleosporaceae | |
| 1504 | Pleosporales | Pleosporaceae | |
| 1505 | Pleosporales | Pleosporaceae | |
| 1506 | Pleosporales | Pleosporaceae | |
| 1507 | Pleosporales | Pleosporaceae | |
| 1508 | Pleosporales | Pleosporaceae | |
| 1509 | Pleosporales | Pleosporaceae | |
| 1510 | Pleosporales | Pleosporaceae | |
| 1511 | Pleosporales | Pleosporaceae | |
| 1512 | Pleosporales | Pleosporaceae | |
| 1513 | Pleosporales | Pleosporaceae | |
| 1514 | Pleosporales | Pleosporaceae | |
| 1515 | Pleosporales | Pleosporaceae | |
| 1516 | Pleosporales | Pleosporaceae | |
| 1517 | Pleosporales | Pleosporaceae | |
| 1518 | Pleosporales | | |
| 1519 | Pleosporales | | |
| 1520 | Pleosporales | | |
| 1521 | Pleosporales | | |
| 1522 | Pleosporales | | |
| 1523 | Dothideomycetes | | |
| 1524 | Dothideomycetes | | |
| 1525 | Dothideomycetes | | |
| 1526 | Dothideomycetes | | |
| 1527 | Eurotiales | Aspergillaceae | |
| 1528 | Eurotiales | Trichocomaceae | *Aspergillus* |
| 1529 | Eurotiales | Trichocomaceae | |
| 1530 | Eurotiales | Trichocomaceae | |
| 1531 | Eurotiales | Trichocomaceae | |
| 1532 | Eurotiales | Trichocomaceae | |
| 1533 | Eurotiales | Trichocomaceae | |
| 1534 | Eurotiales | Trichocomaceae | |
| 1535 | Eurotiales | Trichocomaceae | |
| 1536 | Eurotiales | Trichocomaceae | |
| 1537 | Eurotiales | Trichocomaceae | |
| 1538 | Eurotiales | Trichocomaceae | |
| 1539 | Eurotiales | Trichocomaceae | |
| 1540 | Eurotiales | Trichocomaceae | |
| 1541 | Eurotiales | Trichocomaceae | |
| 1542 | Eurotiales | Trichocomaceae | |
| 1543 | Eurotiales | Trichocomaceae | |
| 1544 | Eurotiales | Trichocomaceae | |
| 1545 | Eurotiales | Trichocomaceae | |
| 1546 | Eurotiales | Trichocomaceae | |
| 1547 | Eurotiales | Trichocomaceae | |
| 1548 | Eurotiales | Trichocomaceae | |
| 1549 | Eurotiales | Trichocomaceae | |
| 1550 | Eurotiales | Trichocomaceae | |
| 1551 | Eurotiales | Trichocomaceae | |
| 1552 | Eurotiales | Trichocomaceae | |
| 1553 | Eurotiales | Trichocomaceae | |
| 1554 | Eurotiales | Trichocomaceae | |
| 1555 | Eurotiales | Trichocomaceae | |
| 1556 | Eurotiales | Trichocomaceae | |
| 1557 | Eurotiales | Trichocomaceae | |

TABLE 17-continued

Phylogeny and OTU designation of the endophytes useful for use in the present invention.

| | | | |
|---|---|---|---|
| 1558 | Eurotiales | Trichocomaceae | |
| 1559 | Eurotiales | Trichocomaceae | |
| 1560 | Eurotiales | | |
| 1561 | Erysiphales | Erysiphaceae | |
| 1562 | Helotiales | Sclerotiniaceae | |
| 1563 | Helotiales | | |
| 1564 | Orbiliales | Orbiliaceae | |
| 1565 | Saccharomycetales | Debaryomycetaceae | |
| 1566 | Saccharomycetales | Incertae sedis | |
| 1567 | Saccharomycetales | Incertae sedis | |
| 1568 | Saccharomycetales | Incertae sedis | |
| 1569 | Coniochaetales | Coniochaetaceae | |
| 1570 | Diaporthales | Incertae sedis | |
| 1571 | Hypocreales | Cordycipitaceae | |
| 1572 | Hypocreales | Cordycipitaceae | |
| 1573 | Hypocreales | Hypocreaceae | |
| 1574 | Hypocreales | Hypocreaceae | |
| 1575 | Hypocreales | Hypocreaceae | |
| 1576 | Hypocreales | Hypocreaceae | |
| 1577 | Hypocreales | Hypocreaceae | |
| 1578 | Hypocreales | Hypocreales incertae sedis | *Acremonium* |
| 1579 | Hypocreales | Hypocreales incertae sedis | *Emericellopsis* |
| 1580 | Hypocreales | Incertae sedis | *Acremonium* |
| 1581 | Hypocreales | Incertae sedis | |
| 1582 | Hypocreales | Incertae sedis | |
| 1583 | Hypocreales | Incertae sedis | |
| 1584 | Hypocreales | Incertae sedis | |
| 1585 | Hypocreales | Nectriaceae | |
| 1586 | Hypocreales | Nectriaceae | |
| 1587 | Hypocreales | Nectriaceae | |
| 1588 | Hypocreales | Nectriaceae | |
| 1589 | Hypocreales | Nectriaceae | |
| 1590 | Hypocreales | Nectriaceae | |
| 1591 | Hypocreales | Nectriaceae | |
| 1592 | Hypocreales | Nectriaceae | |
| 1593 | Hypocreales | Nectriaceae | |
| 1594 | Hypocreales | Nectriaceae | |
| 1595 | Hypocreales | Nectriaceae | |
| 1596 | Hypocreales | Nectriaceae | |
| 1597 | Hypocreales | Nectriaceae | |
| 1598 | Hypocreales | | |
| 1599 | Hypocreales | | |
| 1600 | Incertae sedis | Glomerellaceae | |
| 1601 | Sordariomycetes | | |
| 1602 | Sordariomycetes | | |
| 1603 | | | |
| 1604 | | | |
| 1605 | | | |
| 1606 | | | |
| 1607 | | | |
| 1608 | | | |
| 1609 | | | |
| 1610 | | | |
| 1611 | | | |
| 1612 | | | |
| 1613 | | | |
| 1614 | Cantharellales | Ceratobasidiaceae | |
| 1615 | Cantharellales | Hydnaceae | |
| 1616 | Corticiales | Corticiaceae | |
| 1617 | Hymenochaetales | Incertae sedis | *Trichaptum* |
| 1618 | Russulales | Stereaceae | |
| 1619 | Russulales | | |
| 1620 | Erythrobasidiales | Incertae sedis | |
| 1621 | Sporidiobolales | Incertae sedis | |
| 1622 | Sporidiobolales | Incertae sedis | |
| 1623 | Sporidiobolales | Incertae sedis | |
| 1624 | Sporidiobolales | Incertae sedis | |
| 1625 | Sporidiobolales | Incertae sedis | |
| 1626 | Sporidiobolales | Incertae sedis | |
| 1627 | Sporidiobolales | Incertae sedis | |
| 1628 | Sporidiobolales | Incertae sedis | |
| 1629 | Sporidiobolales | Incertae sedis | |
| 1630 | Sporidiobolales | | |
| 1631 | Cystofilobasidiales | Cystofilobasidiaceae | |
| 1632 | Cystofilobasidiales | Cystofilobasidiaceae | |
| 1633 | Cystofilobasidiales | Cystofilobasidiaceae | |

TABLE 17-continued

Phylogeny and OTU designation of the endophytes useful for use in the present invention.

| | | | |
|---|---|---|---|
| 1634 | Filobasidiales | Filobasidiaceae | |
| 1635 | Filobasidiales | Filobasidiaceae | |
| 1636 | Filobasidiales | Filobasidiaceae | |
| 1637 | Filobasidiales | Filobasidiaceae | |
| 1638 | Filobasidiales | Filobasidiaceae | |
| 1639 | Filobasidiales | Filobasidiaceae | |
| 1640 | Filobasidiales | Filobasidiaceae | |
| 1641 | Tremellales | Incertae sedis | |
| 1642 | Tremellomycetes | | |
| 1643 | | | |
| 1644 | Mortierellales | Mortierellaceae | *Mortierella* |
| 1645 | Mortierellales | Mortierellaceae | |
| 1646 | Mortierellales | Mortierellaceae | |
| 1647 | Mortierellales | Mortierellaceae | |
| 1648 | Mucorales | Rhizopodaceae | |
| 1649 | | | |
| 1650 | | | |
| 1651 | | | |
| 1652 | | | |
| 1653 | | | |
| 1654 | | | |
| 1655 | | | |
| 1656 | | | |
| 1657 | | | |
| 1658 | | | |
| 1659 | | | |
| 1660 | | | |
| 1661 | | | |
| 1662 | | | |
| 1663 | | | |
| 1664 | | | |
| 1665 | | | |
| 1666 | | | |
| 1667 | | | |
| 1668 | | | |
| 1669 | | | |
| 1670 | | | |
| 1671 | | | |
| 1672 | | | |
| 1673 | | | |
| 1674 | | | |
| 1675 | | | |
| 1676 | | | |
| 1677 | | | |
| 1678 | | | |
| 1679 | | | |
| 1680 | | | |
| 1681 | | | |
| 1682 | | | |
| 1683 | | | |
| 1684 | | | |
| 1685 | | | |
| 1686 | | | |
| 1687 | | | |
| 1688 | | | |
| 1689 | | | |
| 1690 | | | |
| 1691 | | | |
| 1692 | | | |
| 1693 | | | |
| 1694 | | | |

TABLE 18

Combinations of endophytes exemplifying Pair 498, comprising B1.0|REF99_V4|171 and B1.0|REF99_V4|66.

| ComboID | SEQ ID NO, MIC1 | SYM1-DELETE | MIC1 ID | Genus1 | SEQ ID NO, MIC2 | SYM2 ID-DELETE | MIC2 ID | Genus2 |
|---|---|---|---|---|---|---|---|---|
| 9_C1_P1 | 1698 | SYM16282 | MIC-54210 | Citrobacter | 1695 | SYM00043 | MIC-77594 | Pantoea |
| 9_C1_P2 | 1698 | SYM16282 | MIC-54210 | Citrobacter | 1696 | SYM00176 | MIC-84863 | Pantoea |
| 9_C1_P3 | 1698 | SYM16282 | MIC-54210 | Citrobacter | 1695 | SYM00022 | MIC-77594 | Pantoea |
| 9_C1_P4 | 1698 | SYM16282 | MIC-54210 | Citrobacter | 1697 | SYM00819 | MIC-59572 | Pantoea |

TABLE 18-continued

Combinations of endophytes exemplifying Pair 498, comprising B1.0|REF99_V4|171 and B1.0|REF99_V4|66.

| ComboID | SEQ ID NO, MIC1 | SYM1-DELETE | MIC1 ID | Genus1 | SEQ ID NO, MIC2 | SYM2 ID-DELETE | MIC2 ID | Genus2 |
|---|---|---|---|---|---|---|---|---|
| 9_C2_P1 | 1699 | SYM16285 | MIC-18309 | Citrobacter | 1695 | SYM00043 | MIC-77594 | Pantoea |
| 9_C2_P2 | 1699 | SYM16285 | MIC-18309 | Citrobacter | 1696 | SYM00176 | MIC-84863 | Pantoea |
| 9_C2_P3 | 1699 | SYM16285 | MIC-18309 | Citrobacter | 1695 | SYM00022 | MIC-77594 | Pantoea |
| 9_C2_P4 | 1699 | SYM16285 | MIC-18309 | Citrobacter | 1697 | SYM00819 | MIC-59572 | Pantoea |
| 9_C3_P1 | 1700 | SYM16349 | MIC-68866 | Citrobacter | 1695 | SYM00043 | MIC-77594 | Pantoea |
| 9_C3_P2 | 1700 | SYM16349 | MIC-68866 | Citrobacter | 1696 | SYM00176 | MIC-84863 | Pantoea |
| 9_C3_P3 | 1700 | SYM16349 | MIC-68866 | Citrobacter | 1695 | SYM00022 | MIC-77594 | Pantoea |
| 9_C3_P4 | 1700 | SYM16349 | MIC-68866 | Citrobacter | 1697 | SYM00819 | MIC-59572 | Pantoea |
| 9_C4_P1 | 1702 | SYM16362 | MIC-97660 | Citrobacter | 1695 | SYM00043 | MIC-77594 | Pantoea |
| 9_C4_P2 | 1702 | SYM16362 | MIC-97660 | Citrobacter | 1696 | SYM00176 | MIC-84863 | Pantoea |
| 9_C4_P3 | 1702 | SYM16362 | MIC-97660 | Citrobacter | 1695 | SYM00022 | MIC-77594 | Pantoea |
| 9_C4_P4 | 1702 | SYM16362 | MIC-97660 | Citrobacter | 1697 | SYM00819 | MIC-59572 | Pantoea |
| 9_C5_P1 | 1703 | SYM16378 | MIC-87219 | Citrobacter | 1695 | SYM00043 | MIC-77594 | Pantoea |
| 9_C5_P2 | 1703 | SYM16378 | MIC-87219 | Citrobacter | 1696 | SYM00176 | MIC-84863 | Pantoea |
| 9_C5_P3 | 1703 | SYM16378 | MIC-87219 | Citrobacter | 1695 | SYM00022 | MIC-77594 | Pantoea |
| 9_C5_P4 | 1703 | SYM16378 | MIC-87219 | Citrobacter | 1697 | SYM00819 | MIC-59572 | Pantoea |
| 9_C6_P1 | 1701 | SYM16352 | MIC-76610 | Citrobacter | 1695 | SYM00043 | MIC-77594 | Pantoea |
| 9_C6_P2 | 1701 | SYM16352 | MIC-76610 | Citrobacter | 1696 | SYM00176 | MIC-84863 | Pantoea |
| 9_C6_P3 | 1701 | SYM16352 | MIC-76610 | Citrobacter | 1695 | SYM00022 | MIC-77594 | Pantoea |
| 9_C6_P4 | 1701 | SYM16352 | MIC-76610 | Citrobacter | 1697 | SYM00819 | MIC-59572 | Pantoea |

TABLE 19

Selection of endophytes useful for use in the present invention.

| SEQ ID NO | Microbe ID | Genus | 16S sequence |
|---|---|---|---|
| 1695 | MIC-77594 | Pantoea | GCTCAGATTGAACGCTGGCGGCAGGCCTAACACATGCAAGTCGAACGGCAGCACAGAAGAGCTTGCTCTT TGGGTGGCGAGTGGCGGACGGGTGAGTAATGTCTGGGAAACTGCCCGATGGAGGGGGATAACTACTGGA AACGGTAGCTAATACCGCATAACGTCGCAAGACCAAAGTGGGGGACCTTCGGGCCTCACACCATCGGATG TGCCCAGATGGGATTAGCTAGTAGGTGGGGTAATGGCTCACCTAGGCGACGATCCCTAGCTGGTCTGAGA GGATGACCAGCCACACTGGAACTGAGACACGGTCCAGACTCCTACGGGAGGCAGCAGTGGGGAATATTG CACAATGGGCGCAAGCCTGATGCAGCCATGCCGCGTGTATGAAGAAGGCCTTCGGGTTGTAAAGTACTTT CAGCGGGGAGGAAGGCGGTGAGGTTAATAACCTTGCCGATTGACGTTACCCGCAGAAGAAGCACCGGCT AACTCCGTGCCAGCAGCCGCGGTAATACGGAGGGTGCAAGCGTTAATCGGAATTACTGGGCGTAAAGCGC ACGCAGGCGGTCTGTTAAGTCAGATGTGAAATCCCCGGGCTTAACCTGGGAACTGCATTTGAAACTGGCA GGCTTGAGTCTCGTAGAGGGGGGTAGAATTCCAGGTGTAGCGGTGAAATGCGTAGAGATCTGGAGGAATA CCGGTGGCGAAGGCGGCCCCCTGGACGAAGACTGACGCTCAGGTGCGAAAGCGTGGGGAGCAAACAGGA TTAGATACCCTGGTAGTCCACGCCGTAAACGATGTCGACTTGGAGGTTGTGCCCTTGAGGCGTGGCTTCCG GAGCTAACGCGTTAAGTCGACCGCCTGGGGAGTACGGCCGCAAGGTTAAAACTCAAATGAATTGACGGGG GCCCGCACAAGCGGTGGAGCATGTGGTTTAATTCGATGCAACGCGAAGAACCTTACCTGGCCTTGACATC CAGAGAACTTAGCAGAGATGCTTTGGTGCCTTCGGGAACTCTGAGACAGGTGCTGCATGGCTGTCGTCAG CTCGTGTTGTGAAATGTTGGGTTAAGTCCCGCAACGAGCGCAACCCTTATCCTTTGTTGCCAGCGGCTCGG CCGGGAACTCAAAGGAGACTGCCGGTGATAAACCGGAGGAAGGTGGGGATGACGTCAAGTCATCATGGC CCTTACGGCCAGGGCTACACACGTGCTACAATGGCGCATACAAAGAGAAGCGACCTCGCGAGAGCAAGC GGACCTCATAAAGTGCGTCGTAGTCCGGATTGGAGTCTGCAACTCGACTCCATGAAGTCGGAATCGCTAG TAATCGTAGATCAGAATGCTACGGTGAATACGTTCCCGGGCCTTGTACACACCGCCCGTCACACCATGGG AGTGGGTTGCAAAAGAAGTAGGTAGCTTAACCTTCGGGAGGGCGCTTACCACTTTGTGATTCATGACTGG GGTGAA |
| 1696 | MIC-84863 | Pantoea | TGGCTCAGATTGAACGCTGGCGGCAGGCCTAACACATGCAAGTCGGACGGTAGCACAGAGGAGCTTGCTC CTCGGGTGACGAGTGGCGGACGGGTGAGTAATGTCTGGGGATCTGCCCGATAGAGGGGGATAACCACTGG AAACGGTGGCTAATACCGCATAACGTCGCAAGACCAAAGAGGGGGACCTTCGGGCCTCTCACTATCGGAT GAACCCAGATGGGATTAGCTAGTAGGCGGGTAACGGCCCACCTAGGCGACGATCCCTAGCTGGTCTGAG AGGATGACCAGCCACACTGGAACTGAGACACGGTCCAGACTCCTACGGGAGGCAGCAGTGGGGAATATT GCACAATGGGCGCAAGCCTGATGCAGCCATGCCGCGTGTATGAAGAAGGCCTTCGGGTTGTAAAGTACTT TCAGCGGGGAGGAAGGCAGTGAGGTTAATAACCTTACTGATTGACGTTACCCGCAGAAGAAGCACCGGCT AACTCCGTGCCAGCAGCCGCGGTAATACGGAGGGTGCAAGCGTTAATCGGAATTACTGGGCGTAAAGCGC ACGCAGGCGGTCTGTTAAGTCAGATGTGAAATCCCCGGGCTTAACCTGGGAACTGCATTTGAAACTGGCA GGCTTGAGTCTCGTAGAGGGGGGTAGAATTCCAGGTGTAGCGGTGAAATGCGTAGAGATCTGGAGGAATA CCGGTGGCGAAGGCGGCCCCCTGGACGAAGACTGACGCTCAGGTGCGAAAGCGTGGGGAGCAAACAGGA TTAGATACCCTGGTAGTCCACGCCGTAAACGATGTCGACTTGGAGGTTGTTCCCTTGAGGAGTGGCTTCCG GAGCTAACGCGTTAAGTCGACCGCCTGGGGAGTACGGCCGCAAGGTTAAAACTCAAATGAATTGACGGGG GCCCGCACAAGCGGTGGAGCATGTGGTTTAATTCGATGCAACGCGAAGAACCTTACCTACTCTTGACATCC ACGGAATTCGGCAGAGATGCCTTAGTGCCTTCGGGAACCGTGAGACAGGTGCTGCATGGCTGTCGTCAGC TCGTGTTGTGAAATGTTGGGTTAAGTCCCGCAACGAGCGCAACCCTTATCCTTTGTTGCCAGCGATTCGGT CGGGAACTCAAAGGAGACTGCCGGTGATAAACCGGAGGAAGGTGGGGATGACGTCAAGTCATCATGGCC CTTACGAGTAGGGCTACACACGTGCTACAATGGCGCATACAAAGAGAAGCGACCTCGCGAGAGCAAGCG GACCTCATAAAGTGCGTCGTAGTCCGGATCGGAGTCTGCAACTCGACTCCGTGAAGTCGGAATCGCTAGT |

TABLE 19-continued

Selection of endophytes useful for use in the present invention.

| SEQ ID NO | Microbe ID | Genus | 16S sequence |
|---|---|---|---|
| | | | AATCGTGGATCAGAATGCCACGGTGAATACGTTCCCGGGCCTTGTACACACCGCCCGTCACACCATGGGA GTGGGTTGCAAAAGAAGTAGGTAGCTTAACCTCCGGGAGGGCGCTTACCACTTTGTGATTCATGACTGGG GTGAA |
| 1697 | MIC-59572 | Pantoea | ATGGCTCAGATTGAACGCTGGCGGCAGGCCTAACACATGCAAGTCGGACGGTAGCACAGAGGAGCTTGCT CCTCGGGTGACGAGTGGCGGACGGGTGAGTAATGTCTGGGGATCTGCCCGATAGAGGGGGATAACCACTG GAAACGGTGGCTAATACCGCATAACGTCGCAAGACCAAAGAGGGGGACCTTCGGGCCTCTCACTATCGGA TGAACCCAGATGGGATTAGCTAGTAGGCGGGGTAACGGCCCACCTAGGCGACGATCCCTAGCTGGTCTGA GAGGATGACCAGCCACACTGGAACTGAGACACGGTCCAGACTCCTACGGGAGGCAGCAGTGGGGAATAT TGCACAATGGGCGCAAGCCTGATGCAGCCATGCCGCGTGTATGAAGAAGGCCTTCGGGTTGTAAAGTACT TTCAGCGGGGAGGAAGGCGATAAGGTTAATAACCTTGTCGATTGACGTTACCCGCAGAAGAAGCACCGGC TAACTCCGTGCCAGCAGCCGCGGTAATACGGAGGGTGCAAGCGTTAATCGGAATTACTGGGCGTAAAGCG CACGCAGGCGGTCTGTTAAGTCAGATGTGAAATCCCCGGGCTTAACCTGGGAACTGCATTTGAAACTGGC AGGCTTGAGTCTCGTAGAGGGGGGTAGAATTCCAGGTGTAGCGGTGAAATGCGTAGAGATCTGGAGGAAT ACCGGTGGCGAAGGCGGCCCCCTGGACGAAGACTGACGCTCAGGTGCGAAAGCGTGGGGAGCAAACAGG ATTAGATACCCTGGTAGTCCACGCCGTAAACGATGTCGACTTGGAGGTTGTTCCCTTGAGGAGTGGCTTCC GGAGCTAACGCGTTAAGTCGACCGCCTGGGGAGTACGGCCGCAAGGTTAAAACTCAAATGAATTGACGGG GGCCCGCACAAGCGGTGGAGCATGTGGTTTAATTCGATGCAACGCGAAGAACCTTACCTACTCTTGACAT CCACGGAATTCGGCAGAGATGCCTTAGTGCCTTCGGGAACCGTGAGACAGGTGCTGCATGGCTGTCGTCA GCTCGTGTTGTGAAATGTTGGGTTAAGTCCCGCAACGAGCGCAACCCTTATCCTTTGTTGCCAGCGATTCG GTCGGGAACTCAAAGGAGACTGCCGGTGATAAACCGGAGGAAGGTGGGGATGACGTCAAGTCATCATGG CCCTTACGAGTAGGGCTACACACGTGCTACAATGGCGCATACAAAGAGAAGCGACCTCGCGAGAGCAAG CGGACCTCATAAAGTGCGTCGTAGTCCGGATCGGAGTCTGCAACTCGACTCCGTGAAGTCGGAATCGCTA GTAATCGTGGATCAGAATGCCACGGTGAATACGTTCCCGGGCCTTGTACACACCGCCCGTCACACCATG GAGTGGGTTGCAAAAGAAGTAGGTAGCTTAACCTCCGGGAGGGCGCTTACCACTTTGTGATTCATGACTG GGGTGAAGTC |
| 1698 | MIC-54210 | Citrobacter | TGGCTCAGATTGAACGCTGGCGGCAGGCCTAACACATGCAAGTCGAACGGTAACAGGAAGCAGCTTGCTG CTTCGCTGACGAGTGGCGGACGGGTGAGTAATGTCTGGGAAACTGCCTGATGAGGGGGATAACTACTGG AAACGGTAGCTAATACCGCATAATGTCGCAAGACCAAAGAGGGGGACCTTCGGGCCTCTTGCCATCGGAT GTGCCCAGATGGGATTAGCTAGTAGGTGGGGTAACGGCTCACCTAGGCGACGATCCCTAGCTGGTCTGAG AGGATGACCAGCCACACTGGAACTGAGACACGGTCCAGACTCCTACGGGAGGCAGCAGTGGGGAATATT GCACAATGGGCGCAAGCCTGATGCAGCCATGCCGCGTGTATGAAGAAGGCCTTCGGGTTGTAAAGTACTT TCAGCGGGGAGGAAGGCGATAAGGTTAATAACCTTGTCGATTGACGTTACCCGCAGAAGAAGCACCGGCT AACTCCGTGCCAGCAGCCGCGGTAATACGGAGGGTGCAAGCGTTAATCGGAATTACTGGGCGTAAAGCGC ACGCAGGCGGTCTGTCAAGTCGGATGTGAAATCCCCGGGCTCAACCTGGGAACTGCATTCGAAACTGGCA GGCTAGAGTCTTGTAGAGGGGGGTAGAATTCCAGGTGTAGCGGTGAAATGCGTAGAGATCTGGAGGAATA CCGGTGGCGAAGGCGGCCCCCTGGACAAAGACTGACGCTCAGGTGCGAAAGCGTGGGGAGCAAACAGGA TTAGATACCCTGGTAGTCCACGCCGTAAACGATGTCGACTTGGAGGTTGTGCCCTTGAGGCGTGGCTTCCG GAGCTAACGCGTTAAGTCGACCGCCTGGGGAGTACGGCCGCAAGGTTAAAACTCAAATGAATTGACGGGG GCCCGCACAAGCGGTGGAGCATGTGGTTTAATTCGATGCAACGCGAAGAACCTTACCTACTCTTGACATCC AGAGAACTTAGCAGAGATGCTTTGGTGCCTTCGGGAACTCTGAGACAGGTGCTGCATGGCTGTCGTCAGC TCGTGTTGTGAAATGTTGGGTTAAGTCCCGCAACGAGCGCAACCCTTATCCTTTGTTGCCAGCGGTTAGGC CGGGAACTCAAAGGAGACTGCCAGTGATAAACTGGAGGAAGGTGGGGATGACGTCAAGTCATCATGGCC CTTACGAGTAGGGCTACACACGTGCTACAATGGCGCATACAAAGAGAAGCGACCTCGCGAGAGCAAGCG GACCTCATAAAGTGCGTCGTAGTCCGGATTGGAGTCTGCAACTCGACTCCATGAAGTCGGAATCGCTAGT AATCGTGGATCAGAATGCCACGGTGAATACGTTCCCGGGCCTTGTACACACCGCCCGTCACACCATGGGA GTGGGTTGCAAAAGAAGTAGGTAGCTTAACCTTCGGGAGGGCGCTTACCACTTTGTGATTCATGACTGGG GTGA |
| 1699 | MIC-18309 | Citrobacter | GCTCAGATTGAACGCTGGCGGCAGGCCTAACACATGCAAGTCGAGCGGTAGCACAGAGGAGCTTGCTCTCG GGTGACGAGTGGCGGACGGGTGAGTAATGTCTGGGAAACTGCCTGATGGAGGGGGATAACTACTGGAAA CGGTAGCTAATACCGCATAACGTCGCAAGACCAAAGAGGGGGACCTTCGGGCCTCTTGCCATCAGATGTG CCCAGATGGGATTAGCTAGTAGGTGGGGTAACGGCTCACCTAGGCGACGATCCCTAGCTGGTCTGAGAGG ATGACCAGCCACACTGGAACTGAGACACGGTCCAGACTCCTACGGGAGGCAGCAGTGGGGAATATTGCAC AATGGGCGCAAGCCTGATGCAGCCATGCCGCGTGTATGAAGAAGGCCTTCGGGTTGTAAAGTACTTTCAG CGGGGAGGAAGGCGATAAGGTTAATAACCTTGTCGATTGACGTTACCGCAGAAGAAGCACCGGCTAACT CCGTGCCAGCAGCCGCGGTAATACGGAGGGTGCAAGCGTTAATCGGAATTACTGGGCGTAAAGCGCACGC AGGCGGTCTGTCAAGTCGGATGTGAAATCCCCGGGCTCAACCTGGGAACTGCATTCGAAACTGGCAGGCT AGAGTCTTGTAGAGGGGGGTAGAATTCCAGGTGTAGCGGTGAAATGCGTAGAGATCTGGAGGAATACCG GTGGCGAAGGCGGCCCCCTGGACAAAGACTGACGCTCAGGTGCGAAAGCGTGGGGAGCAAACAGGATTA GATACCCTGGTAGTCCACGCCGTAAACGATGTCGACTTGGAGGTTGTGCCCTTGAGGCGTGGCTTCCGGAG CTAACGCGTTAAGTCGACCGCCTGGGGAGTACGGCCGCAAGGTTAAAACTCAAATGAATTGACGGGGGCC CGCACAAGCGGTGGAGCATGTGGTTTAATTCGATGCAACGCGAAGAACCTTACCTACTCTTGACATCCAG AGAACTTAGCAGAGATGCTTTGGTGCCTTCGGGAACTCTGAGACAGGTGCTGCATGGCTGTCGTCAGCTCG TGTTGTGAAATGTTGGGTTAAGTCCCGCAACGAGCGCAACCCTTATCCTTTGTTGCCAGCGGTTAGGCCGG GAACTCAAAGGAGACTGCCAGTGATAAACTGGAGGAAGGTGGGGATGACGTCAAGTCATCATGGCCCTTA CGAGTAGGGCTACACACGTGCTACAATGGCGCATACAAAGAGAAGCGACCTCGCGAGAGCAAGCGGACC TCATAAAGTGCGTCGTAGTCCGGATTGGAGTCTGCAACTCGACTCCATGAAGTCGGAATCGCTAGTAATCG TAGATCAGAATGCTACGGTGAATACGTTCCCGGGCCTTGTACACACCGCCCGTCACACCATGGGAGTGGG TTGCAAAAGAAGTAGGTAGCTTAACCTTCGGGAGGGCGCTTACCACTTTGTGATTCATGACTGGGGTGAA GTC |

TABLE 19-continued

Selection of endophytes useful for use in the present invention.

| SEQ ID NO | Microbe ID | Genus | 16S sequence |
|---|---|---|---|
| 1700 | MIC-68866 | Citrobacter | GGCTCAGATTGAACGCTGGCGGCAGGCCTAACACATGCAAGTCGAACGGTAACAGGAAGCAGCTTGCTGC TTTGCTGACGAGTGGCGGACGGGTGAGTAATGTCTGGGAAACTGCCTGATGGAGGGGGATAACTACTGGA AACGGTAGCTAATACCGCATAACGTCGCAAGACCAAAGAGGGGGACCTTCGGGCCTCTTGCCATCGGATG TGCCCAGATGGGATTAGCTAGTAGGTGGGGTAACGGCTCACCTAGGCGACGATCCCTAGCTGGTCTGAGA GGATGACCAGCCACACTGGAACTGAGACACGGTCCAGACTCCTACGGGAGGCAGCAGTGGGGAATATTG CACAATGGGCGCAAGCCTGATGCAGCCATGCCGCGTGTATGAAGAAGGCCTTCGGGTTGTAAAGTACTTT CAGCGGGGAGGAAGGTGTTGAGGTTAATAACCTCAGCAATTGACGTTACCCGCAGAAGAAGCACCGGCTA ACTCCGTGCCAGCAGCCGCGGTAATACGGAGGGTGCAAGCGTTAATCGGAATTACTGGGCGTAAAGCGCA CGCAGGCGGTCTGTCAAGTCGGATGTGAAATCCCCGGGCTCAACCTGGGAACTGCATTCGAAACTGGCAG GCTAGAGTCTTGTAGAGGGGGGTAGAATTCCAGGTGTAGCGGTGAAATGCGTAGAGATCTGGAGGAATAC CGGTGGCGAAGGCGGCCCCCTGGACAAAGACTGACGCTCAGGTGCGAAAGCGTGGGGAGCAAACAGGAT TAGATACCCTGGTAGTCCACGCCGTAAACGATGTCGACTTGGAGGTTGTGCCCTTGAGGCGTGGCTTCCGG AGCTAACGCGTTAAGTCGACCGCCTGGGGAGTACGGCCGCAAGGTTAAAACTCAAATGAATTGACGGGGG CCCGCACAAGCGGTGGAGCATGTGGTTTAATTCGATGCAACGCGAAGAACCTTACCTACTCTTGACATCCA GAGAACTTTCCAGAGATGGATTGGTGCCTTCGGGAACTCTGAGACAGGTGCTGCATGGCTGTCGTCAGCTC GTGTTGTGAAATGTTGGGTTAAGTCCCGCAACGAGCGCAACCCTTATCCTTTGTTGCCAGCGGTTAGGCCG GGAACTCAAAGGAGACTGCCAGTGATAAACTGGAGGAAGGTGGGGATGACGTCAAGTCATCATGGCCCTT ACGAGTAGGGCTACACACGTGCTACAATGGCGCATACAAAGAGAAGCGACCTCGCGAGAGCAAGCGGAC CTCATAAAGTGCGTCGTAGTCCGGATTGGAGTCTGCAACTCGACTCCATGAAGTCGGAATCGCTAGTAATC GTGGATCAGAATGCCACGGTGAATACGTTCCCGGGCCTTGTACACACCGCCCGTCACACCATGGGAGTGG GTTGCAAAAGAAGTAGGTAGCTTAACCTTCGGGAGGGCGCTTACCACTTTGTGATTCATGACTGGGGTGA AGTC |
| 1701 | MIC-76610 | Citrobacter | GCTCAGATTGAACGCTGGCGGCAGGCCTAACACATGCAAGTCGAACGGTAGCACAGGGGAGCTTGCTCCC CGGGTGACGAGTGGCGGACGGGTGAGTAATGTCTGGGAAACTGCCCGATGGAGGGGGATAACTACTGGA AACGGTAGCTAATACCGCATAACGTCTTGGACCAAAGTGGGGGACCTTCGGGCCTCACGCCATCGGATG TGCCCAGATGGGATTAGCTAGTAGGTGGGGTAACGGCTCACCTAGGCGACGATCCCTAGCTGGTCTGAGA GGATGACCAGCCACACTGGAACTGAGACACGGTCCAGACTCCTACGGGAGGCAGCAGTGGGGAATATTG CACAATGGGCGCAAGCCTGATGCAGCCATGCCGCGTGTATGAAGAAGGCCTTCGGGTTGTAAAGTACTTT CAGCGGGGAGGAAGGCGATGCGGTTAATAACCGCGTCGATTGACGTTACCCGCAGAAGAAGCACCGGCT AACTCCGTGCCAGCAGCCGCGGTAATACGGAGGGTGCAAGCGTTAATCGGAATTACTGGGCGTAAAGCGC ACGCAGGCGGTCTGTCAAGTCAGATGTGAAATCCCCGGGCTTAACCTGGGAACTGCATTTGAAACTGGCA GGCTAGAGTCTTGTAGAGGGGGGTAGAATTCCAGGTGTAGCGGTGAAATGCGTAGAGATCTGGAGGAATA CCGGTGGCGAAGGCGGCCCCCTGGACAAAGACTGACGCTCAGGTGCGAAAGCGTGGGGAGCAAACAGGA TTAGATACCCTGGTAGTCCACGCCGTAAACGATGTCGACTTGGAGGCTGTTCCCTTGAGGAGTGGCTTCCG GAGCTAACGCGTTAAGTCGACCGCCTGGGGAGTACGGCCGCAAGGTTAAAACTCAAATGAATTGACGGGG GCCCGCACAAGCGGTGGAGCATGTGGTTTAATTCGATGCAACGCGAAGAACCTTACCTGGCCTTGACATC CACGGAATTCGGCAGAGATGCCTTAGTGCCTTCGGGAACCGTGAGACAGGTGCTGCATGGCTGTCGTCAG CTCGTGTGTGAAATGTTGGGTTAAGTCCCGCAACGAGCGCAACCCTTATCCTTTGTTGCCAGCGATTCGG TCGGGAACTCAAAGGAGACTGCCGGTGATAAACCGGAGGAAGGTGGGGATGACGTCAAGTCATCATGGC CCTTACGGCCAGGGCTACACACGTGCTACAATGGCGCATACAAAGAGAAGCGAACTCGCGAGAGCAAGC GGACCTCATAAAGTGCGTCGTAGTCCGGATCGGAGTCTGCAACTCGACTCCGTGAAGTCGGAATCGCTAG TAATCGTGGATCAGAATGCCACGGTGAATACGTTCCCGGGCCTTGTACACACCGCCCGTCACACCATGGG AGTGGGTTGCAAAAGAAGTAGGTAGCTTAACCTTCGGGAGGGCGCTTACCACTTTGTGATTCATGACTGG GGTGAAGTCGTACCAAAGGTA |
| 1702 | MIC-97660 | Citrobacter | CTCAGATTGAACGCTGGCGGCAGGCCTAACACATGCAAGTCGAACGGTAACAGGAAGCAGCTTGCTGCTT TGCTGACGAGTGGCGGACGGGTGAGTAATGTCTGGGAAACTGCCTGATGGAGGGGGATAACTACTGGAA ACGGTAGCTAATACCGCATAACGTCGCAAGACCAAAGAGGGGGACCTTCGGGCCTCTTGCCATCGGATGT GCCCAGATGGGATTAGCTAGTAGGTGGGGTAACGGCTCACCTAGGCGACGATCCCTAGCTGGTCTGAGAG GATGACCAGCCACACTGGAACTGAGACACGGTCCAGACTCCTACGGGAGGCAGCAGTGGGGAATATTGC ACAATGGGCGCAAGCCTGATGCAGCCATGCCGCGTGTATGAAGAAGGCCTTCGGGTTGTAAAGTACTTTC AGCGGGGAGGAAGGTGTTGAGGTTAATAACCTCAGCAATTGACGTTACCCGCAGAAGAAGCACCGGCTA ACTCCGTGCCAGCAGCCGCGGTAATACGGAGGGTGCAAGCGTTAATCGGAATTACTGGGCGTAAAGCGCA CGCAGGCGGTCTGTCAAGTCGGATGTGAAATCCCCGGGCTCAACCTGGGAACTGCATTCGAAACTGGCAG GCTAGAGTCTTGTAGAGGGGGGTAGAATTCCAGGTGTAGCGGTGAAATGCGTAGAGATCTGGAGGAATAC CGGTGGCGAAGGCGGCCCCCTGGACAAAGACTGACGCTCAGGTGCGAAAGCGTGGGGAGCAAACAGGAT TAGATACCCTGGTAGTCCACGCCGTAAACGATGTCGACTTGGAGGTTGTGCCCTTGAGGCGTGGCTTCCGG AGCTAACGCGTTAAGTCGACCGCCTGGGGAGTACGGCCGCAAGGTTAAAACTCAAATGAATTGACGGGGG CCCGCACAAGCGGTGGAGCATGTGGTTTAATTCGATGCAACGCGAAGAACCTTACCTACTCTTGACATCCA GAGAACTTTCCAGAGATGGATTGGTGCCTTCGGGAACTCTGAGACAGGTGCTGCATGGCTGTCGTCAGCTC GTGTTGTGAAATGTTGGGTTAAGTCCCGCAACGAGCGCAACCCTTATCCTTTGTTGCCAGCGGTTAGGCCG GGAACTCAAAGGAGACTGCCAGTGATAAACTGGAGGAAGGTGGGGATGACGTCAAGTCATCATGGCCCTT ACGAGTAGGGCTACACACGTGCTACAATGGCGCATACAAAGAGAAGCGACCTCGCGAGAGCAAGCGGAC CTCATAAAGTGCGTCGTAGTCCGGATTGGAGTCTGCAACTCGACTCCATGAAGTCGGAATCGCTAGTAATC GTGGATCAGAATGCCACGGTGAATACGTTCCCGGGCCTTGTACACACCGCCCGTCACACCATGGGAGTGG GTTGCAAAAGAAGTAGGTAGCTTAACCTTCGGGAGGGCGCTTACCACTTTGTGATTCATGACTGGGGTGA AGTC |
| 1703 | MIC-87219 | Citrobacter | TGGCTCAGATTGAACGCTGGCGGCAGGCCTAACACATGCAAGTCGAACGGTAACAGAGAGCAGCTTGCTG CTCTGCTGACGAGTGGCGGACGGGTGAGTAATGTCTGGGGATCTGCCCCGATGGAGGGGGATAACCACTGG AAACGGTGGCTAATACCGCATAACGTCGCAAGACCAAAGTGGGGGACCTTCGGGCCTCACACCATCGGAT GAACCCAGATGGGATTAGCTAGTAGGTGGGGTAACGGCTCACCTAGGCGACGATCCCTAGCTGGTCTGAG |

TABLE 19-continued

Selection of endophytes useful for use in the present invention.

| SEQ ID NO | Microbe ID | Genus | 16S sequence |
|---|---|---|---|
| | | | AGGATGACCAGCCACACTGGAACTGAGACACGGTCCAGACTCCTACGGGAGGCAGCAGTGGGGAATATT<br>GCACAATGGGCGCAAGCCTGATGCAGCCATGCCGCGTGTATGAAGAAGGCCTTCGGGTTGTAAAGTACTT<br>TCAGCGGGGAGGAAGGGAGTGAGGCTAATAACCTTATTCATTGACGTTACCCGCAGAAGAAGCACCGGCT<br>AACTCCGTGCCAGCAGCCGCGGTAATACGGAGGGTGCAAGCGTTAATCGGAATTACTGGGCGTAAAGCGC<br>ACGCAGGCGGTCTGTCAAGTCGGATGTGAAATCCCCGGGCTCAACCCGGGAACTGCATTCGAAACTGGCA<br>GGCTAGAGTCTCGTAGAGGGGGGTAGAATTCCAGGTGTAGCGGTGAAATGCGTAGAGATCTGGAGGAAT<br>ACCGGTGGCGAAGGCGGCCCCCTGGACGAAGACTGACGCTCAGGTGCGAAAGCGTGGGGAGCAAACAGG<br>ATTAGATACCCTGGTAGTCCACGCCGTAAACGATGTCGACTTGGAGGCTGTGAGCTTGACTCGTGGCTTCC<br>GGAGCTAACGCGTTAAGTCGACCGCCTGGGGAGTACGGCCGCAAGGTTAAAACTCAAATGAATTGACGGG<br>GGCCCGCACAAGCGGTGGAGCATGTGGTTTAATTCGATGCAACGCGAAGAACCTTACCTGGCCTTGACAT<br>CCACGGAATTCTGCAGAGATGCGGAAGTGCCTTCGGGAACCGTGAGACAGGTGCTGCATGGCTGTCGTCA<br>GCTCGTGTTGTGAAATGTTGGGTTAAGTCCCGCAACGAGCGCAACCCTTATCCTTTGTTGCCAGCGGCTCG<br>GCCGGGAACTCAAAGGAGACTGCCGGTGATAAACCGGAGGAAGGTGGGGATGACGTCAAGTCATCATGG<br>CCCTTACGGCCAGGGCTACACACGTGCTACAATGGCGCATACAAAGAGAAGCGACCTCGCGAGAGCAAG<br>CGGACCTCATAAAGTGCGTCGTAGTCCGGATCGGAGTCTGCAACTCGACTCCGTGAAGTCGGAATCGCTA<br>GTAATCGTGGATCAGAATGCCACGGTGAATACGTTCCCGGGCCTTGTACACACCGCCCGTCACACCATGG<br>GAGTGGGTTGCAAAAGAAGTAGGTAGCTTAACCTTCGGAGGGCGCTACCACTTTGTGATTCATGACTG |

Having illustrated and described the principles of the present invention, it should be apparent to persons skilled in the art that the invention can be modified in arrangement and detail without departing from such principles. We claim all modifications that are within the spirit and scope of the appended claims. All publications and published patent documents cited in this specification are incorporated herein by reference to the same extent as if each individual publication or patent application is specifically and individually indicated to be incorporated herein by reference. It is to be understood that while the invention has been described in conjunction with the detailed description thereof, the foregoing description is intended to illustrate and not limit the scope of the invention, which is defined by the scope of the appended claims. Other embodiments, advantages, and modifications are within the scope of the following claims.

SEQUENCE LISTING (1711 sequences)

SEQ ID NO: 1 - DNA, 254 bp, Unknown
  Kingdom: Bacteria, Phylum: Acidobacteria, Class: Acidobacteria, Order: Acidobacteriales, Family: Acidobacteriaceae_(Subgroup_1), Genus: Granulicella
atacgaggggggcaagcgttgttcggaattattgggcgtaaagggtgcgtaggcggtttgacaagtctgatgtgaaatctatgggctcaacccatagtctgcatcggaaactgtcgggcttgagtatgggagaggtgagtggaatttccggtgtagcggtgaaatgcgtagatatcggaaggaacacctgtggcgaaagcggctcactggaccattactgacgctgatgcacgaaagctaggggagcaaacagg

SEQ ID NO: 2 - DNA, 254 bp, Unknown
  Kingdom: Bacteria, Phylum: Acidobacteria, Class: Acidobacteria, Order: Acidobacteriales, Family: Acidobacteriaceae_(Subgroup_1), Genus:
atacagagggtgcgagcgttgttcggaattattgggcgtaaagggcgcgtaggcggcgcggtatgtcacctgtgaaatctcctggctcaactgggagcttgcaggcgaaactgccgtgctggagtgtgggagaggtgcgtggaattcccggtgtagcggtgaaatgcgtagatatcgggaggaacacctgtggcgaaagcggcgcactggaccacaactgacgctgaggcgcgaaagctaggggagcaaacagg

SEQ ID NO: 3 - DNA, 254 bp, Unknown
  Kingdom: Bacteria, Phylum: Acidobacteria, Class: Acidobacteria, Order: Acidobacteriales, Family: Acidobacteriaceae_(Subgroup_1), Genus:
atacgaggggggcaagcgttgttcggaattattgggcgtaaagggtgcgtaggcggtttgacaagtctgatgtgaaatctatgggctcaacccatagtctgcatcggaaactgtcgggcttgagtatgggagaggtgagtggaatttccggtgtagcggtgaaatgcgtagatatcggaaggaacacctgtggcgaaagcggctcactggaccattactgacgctgaggcacgaaagctaggggagcaaacagg

SEQ ID NO: 4 - DNA, 254 bp, Unknown
  Kingdom: Bacteria, Phylum: Acidobacteria, Class: Acidobacteria, Order: Acidobacteriales, Family: Acidobacteriaceae_(Subgroup_1), Genus:
atacagagggtgcaagcgttgttcggaattattgggcgtaaagggcgcgtaggcggtgccacaagtcacttgtgaaatctccgggcttaactcggagcctgcaggcgaaactgtggtgctggagtgtgggagaggtgcgtggaattcccggtgtagcggtgaaatgcgtagatatcgggaggaacacctgtggcgaaagcggcgcactggaccataactgacgctgaggcgcgaaagctaggggagcaaacagg

SEQ ID NO: 5 - DNA, 254 bp, Unknown
  Kingdom: Bacteria, Phylum: Acidobacteria, Class: Acidobacteria, Order: Acidobacteriales, Family: Acidobacteriaceae_(Subgroup_1), Genus:
atacgaggggggcgagcgttgttcggaattattgggcgtaaagggtgcgtaggcggttccgtaagtcctgtgtgaaatcttcgggctcaactcgaagcctgcacgggaaactgcggggcttgagtgtgggagaggtgagtggaattcccggtgtagcggtgaaatgcgtagatatcgggaggaacacctgtggcgaaagcggctcactggaccataactgacgctgatgcacgaaagctgggggagcaaacagg

SEQ ID NO: 6 - DNA, 254 bp, Unknown
  Kingdom: Bacteria, Phylum: Acidobacteria, Class: Acidobacteria, Order: Acidobacteriales, Family: Acidobacteriaceae_(Subgroup_1), Genus:
atacagagggtgcgagcgttgttcggaattattgggcgtaaagggcgcgtaggcggtgcggtaagtcacctgtgaaatctcctggctcaactgggagcttgcaggcgaaactgccgtgctggagtgtgggagaggtgcgtggaattcccggtgtagcggtgaaatgcgtagatatcgggaggaacacctgtggcgaaagcggcgcactggaccacaactgacgctgaggcgcgaaagctaggggagcaaacagg

SEQ ID NO: 7 - DNA, 254 bp, Unknown
  Kingdom: Bacteria, Phylum: Acidobacteria, Class: Acidobacteria, Order: Acidobacteriales, Family: Acidobacteriaceae_(Subgroup_1), Genus:
atacagagggtgcaagcgttgttcggaattattgggcgtaaagggcgcgtaggcggtgctgtaagtctgtggtgaaatctctgggctcaactcagagtctgccatagaaactgcagtgctggagtgtgggagaggtgagtggaattcccggtgtagcggtgaaatgcgtagatatcgggaggaacacctgtggcgaaagcggctcactggaccacaactgacgctgaggcgcgaaagctaggggagcaaacagg

SEQ ID NO: 8 - DNA, 254 bp, Unknown
  Kingdom: Bacteria, Phylum: Acidobacteria, Class: Acidobacteria, Order: Acidobacteriales, Family: Acidobacteriaceae_(Subgroup_1), Genus:
atacagagggtgcgagcgttgttcggaattattgggcgtaaagggcgcgtaggcggttgggtaagtcacctgtgaaatctcctggctcaactgggagcttgcaggcgaaactgcttgactggagtgtgggagaggtgcgtggaattcccggtgtagcggtgaaatgcgtagatatcgggaggaacacctgtggcgaaagcggcgcactggaccacaactgacgctgaggcgcgaaagctaggggagcaaacagg

SEQ ID NO: 9 - DNA, 254 bp, Unknown
  Kingdom: Bacteria, Phylum: Acidobacteria, Class: Acidobacteria, Order: Acidobacteriales, Family: Acidobacteriaceae_(Subgroup_1), Genus:
atacgaggggggcgagcgttgttcggaattattgggcgtaaagggtgcgtaggcggtttggtaagtctgatgtgaaatctatgggctcaactcatagtctgcatcggaaactgccgggcttgagtatgggagaggtgagtggaattcctggtgtagcggtgaaatgcgtagatatcaggaggaacacctgtggcgaaagcggctcactggaccataactgacgctgatgcacgaaagctaggggagcaaacagg

SEQ ID NO: 10 - DNA, 254 bp, Unknown
  Kingdom: Bacteria, Phylum: Acidobacteria, Class: Acidobacteria, Order: Acidobacteriales, Family: Acidobacteriaceae_(Subgroup_1), Genus:
atacgaggggggcaagcgttgttcggaattattgggcgtaaagggtgcgtaggcggtctgacaagtctgatgtgaaatctatgggctcaacccatagtctgcatcggaaactgtcgggcttgagtatgggagaggtgagtggaatttccggtgtagcggtgaaatgcgtagatatcggaaggaacacctgtggcgaaagcggctcactggaccattactgacgctgaggcacgaaagctaggggagcaaacagg

SEQ ID NO: 11 - DNA, 254 bp, Unknown
  Kingdom: Bacteria, Phylum: Acidobacteria, Class: Acidobacteria, Order: Acidobacteriales, Family: Acidobacteriaceae_(Subgroup_1), Genus:
atacgaggggggcaagcgttgttcggaattattgggcgtaaagggtgcgtaggtggttcggcaagtcttgtgtgaaatcttcaggctcaacttgaagtctgcacaagaaactgccgggcttgagtatgggagaggtgagtggaatttccggtgtagcggtgaaatgcgtagatatcggaaggaacacctgtggcgaaagcggctcactggaccattactgacactgaggcacgaaagctaggggagcaaacagg

SEQ ID NO: 12 - DNA, 254 bp, Unknown
  Kingdom: Bacteria, Phylum: Acidobacteria, Class: Acidobacteria, Order: Acidobacteriales, Family: Acidobacteriaceae_(Subgroup_1), Genus:
atacgaggggggcaagcgttgttcggaattattgggcgtaaagggtgcgtaggcggttcggtaagtcttatgtgaaatcttcgggctcaactcgaagtctgcatgagaaactgccgggcttgagtgtgggagaggtgagtggaatttccggtgtagcggtgaaatgcgtagatatcggaaggaacacctgtggcgaaagcggctcactggaccataactgacgctgatgcacgaaagctaggggagcaaacagg

SEQ ID NO: 13 - DNA, 254 bp, Unknown
  Kingdom: Bacteria, Phylum: Acidobacteria, Class: Acidobacteria, Order: Subgroup_2, Family:  , Genus:
aaacgtagggggccagcgttgctcggaattactgggcgtaaagggtccgtaggcggtgcggcaagtcggaagtgaaatctctgggcttaacccagaggctgcttccgaaactgccgtgctagaggatgagagaggcaagtggaattgcgggtgtagcggtgaaatgcgtagatatccgcaggaacatccgaggcgaaagcggcttgctggatcatttctgacgctgagggacgaaagctaggggagcaaacagg

SEQ ID NO: 14 - DNA, 254 bp, Unknown
  Kingdom: Bacteria, Phylum: Acidobacteria, Class: Acidobacteria, Order: Subgroup_2, Family:  , Genus:
agacgtagggggccagcgttgctcggaattactgggtgtaaagggttcgtaggcggtgtggcaagtcgggagtgaaatctctgggctcaacccagagtctgcttccgaaactgctgtgcttgagtgtgggagaggcgcgtggaattgcaggtgtagcggtgaaatgcgtagatatctgcaggaacacccgtggcgaaagcggcgcgctggaccactactgacgctgaggaacgaaagctaggggagcaaacagg

SEQ ID NO: 15 - DNA, 254 bp, Unknown
  Kingdom: Bacteria, Phylum: Acidobacteria, Class: Acidobacteria, Order: Subgroup_3, Family: Unknown_Family, Genus: Bryobacter
atacgtaggcagcaagcgttgttcggaattactgggcgtaaagagtgtgtaggcggtgctctaagttcgttgtgaaatctcccggcttaactgggagggtgcggcggaaactggagtgcttgagcgcgggagaggaaagcggaattcctggtgtagcggtgaaatgcgtagatatcaggaggaacacctgtggtgtagacagctttctggaccgtagctgacgctgagacacgaaagcgtgggtagcaaacagg

SEQ ID NO: 16 - DNA, 254 bp, Unknown
  Kingdom: Bacteria, Phylum: Acidobacteria, Class: Acidobacteria, Order: Subgroup_3, Family: Unknown_Family, Genus: Bryobacter
atacgtaggcagcaagcgttgttcggaattactgggcgtaaagagtgtgtaggcggtgttctaagtctgttgtgaaatctcccggctcaactgggagggtgcggcggagactggaatgctagagtatgggagaggtaagcggaattcctggtgtagcggtgaaatgcgtagatatcaggaggaacacctgtggtgtagacagcttactggaccatgactgacgctgagacacgaaagcgtgggtagcgaacagg

SEQ ID NO: 17 - DNA, 255 bp, Unknown
  Kingdom: Bacteria, Phylum: Acidobacteria, Class: Acidobacteria, Order: Subgroup_3, Family: Unknown_Family, Genus:
atacgtaggcagcgagcgttgttcggagttactgggcgtaaagggtgtgtaggcggttgtttaagtttggtgtgaaatctcccggctcaaccgggagggtgcgccgaatactgaatgacttcgagtgcgggagaggagagtggaattcctggtgtagcggtgaaatgcgtagatatcaggaggaacaccggtggtgtagacggctctctggaccgtaactgacgctgagacacgaaagcgtgggtagcaaacagg

SEQ ID NO: 18 - DNA, 254 bp, Unknown
  Kingdom: Bacteria, Phylum: Acidobacteria, Class: Acidobacteria, Order: Subgroup_3, Family: Unknown_Family, Genus:
atacgtaggcagcgagcgttgttcggagttactgggcgtaaagcgtgcgtaggcggttttgtaagtttggtgtgaaatctcccggctcaactgggagggtgcgccgaaaactgcaaggctggagtgtgggagaggtaggcggaattcctggtgtagcggtgaaatgcgtagatatcaggaggaacacctgtggtgtagacggcttactggaccatgactgacgctgaggcacgaaagcgtggggagcaaacagg

SEQ ID NO: 19 - DNA, 254 bp, Unknown
  Kingdom: Bacteria, Phylum: Acidobacteria, Class: Acidobacteria, Order: Subgroup_3, Family: Unknown_Family, Genus:
atacgtaggcagcgagcgttgttcggaattactgggcgtaaagagtgtgtaggcggtgctctaagttcggtgtgaaatctcctggcttaactgggagggtgcgccggaaactggagtgctcgagcgtgggagaggaaagcggaattcctggtgtagcggtgaaatgcgtagatatcaggaggaacacctgcggtgtagacggctttctggaccattgctgacgctgagacacgaaagcgtgggtagcaaacagg

SEQ ID NO: 20 - DNA, 254 bp, Unknown
  Kingdom: Bacteria, Phylum: Acidobacteria, Class: Acidobacteria, Order: Subgroup_3, Family: Unknown_Family, Genus:
atacgtaggcagcaagcgttgttcggagttactgggcgtaaagggtgcgtaggcggctttttaagtttggtgtgaaatctcccggctcaactgggagggtgcgccgaatactgagaggctagagtgtgggagaggaaagtggaattcctggtgtagcggtgaaatgcgtagatatcaggaggaacaccggtggtgtaaacggctttctggaccataactgacgctgaggcacgaaagcgtgggtagcaaacagg

SEQ ID NO: 21 - DNA, 255 bp, Unknown
  Kingdom: Bacteria, Phylum: Acidobacteria, Class: Acidobacteria, Order: Subgroup_4, Family: RB41, Genus:
atacggggggagcaagcgttgttcggatttactgggcgtaaagggcgcgtaggcggccaccgcaagtcggttgtgaaatctccgggcttaacccggaaaggtcaatcgatactgcggggctagagtgcagaaggggcaactggaattctcggtgtagcggtgaaatgcgtagatatcgagaggaacacctgcggcgaaggcgggttgctgggctgacactgacgctgaagcgcgaaagctaggggagcgaacggg

SEQ ID NO: 22 - DNA, 255 bp, Unknown
  Kingdom: Bacteria, Phylum: Acidobacteria, Class: Acidobacteria, Order: Subgroup_4, Family: RB41, Genus:
atacggggggagcaagcgttgttcggatttactgggcgtaaagggcgcgtaggcggccaccgcaagtcgactgtgaaatctccgggcttaacccggaaaggtcagccgatactgcggggctagagtgcagaaggggcaactggaattctcggtgtagcggtgaaatgcgtagatatcgagaggaacacctgcggcgaaggcgggttgctgggctgacactgacgctgaggcgcgaaagctaggggagcgaacggg

SEQ ID NO: 23 - DNA, 255 bp, Unknown
  Kingdom: Bacteria, Phylum: Acidobacteria, Class: Acidobacteria, Order: Subgroup_4, Family: RB41, Genus:
atacggggggagcaagcgttgttcggatttactgggcgtaaagggcgcgtaggcggtcgtgacaagtcacttgtgaaatctccgggcttaactcggaacggtcaagtgatactgtcggactagagtacagaaggggcaactggaattctcggtgtagcggtgaaatgcgtagatatcgagaggaacacctgcggcgaaggcgggttgctgggctgatactgacgctgaggcgcgaaagccaggggagcgaacggg

SEQ ID NO: 24 - DNA, 254 bp, Unknown
  Kingdom: Bacteria, Phylum: Acidobacteria, Class: Acidobacteria, Order: Subgroup_4, Family: RB41, Genus:
atacggggggagcaagcgttgttcggatttactgggcgtaaagggcgcgtaggcggcgcaacaagtcacttgtgaaatctccgggcttaacccggagcggtcaagtgatactgtcgtgctagagtgcggaaggggcaactggaattctcggtgtagcggtgaaatgcgtagatatcgagaggaacacctgcggcgaaggcgggttgctgggccgacactgacgctgaggcgcgaaagccaggggagcgaacggg

SEQ ID NO: 25 - DNA, 254 bp, Unknown
  Kingdom: Bacteria, Phylum: Acidobacteria, Class: Acidobacteria, Order: Subgroup_4, Family: RB41, Genus:
atacggggggagcaagcgttgttcggatttactgggcgtaaagggcgcgtaggcggcgcaacaagtcacttgtgaaatctccgggcttaactcggagcggccaagtgatactgtcgtgctagagtgcggaaggggcaactggaattctcggtgtagcggtgaaatgcgtagatatcgagaggaacacctgcggcgaaggcgggttgctgggccgacactgacgctgaggcgcgaaagccaggggagcgaacggg

SEQ ID NO: 26 - DNA, 255 bp, Unknown
  Kingdom: Bacteria, Phylum: Acidobacteria, Class: Acidobacteria, Order: Subgroup_4, Family: RB41, Genus:
atacggggggagcaagcgttgttcggatttactgggcgtaaagggcgcgtaggcggtcagcacaagtcagttgtgaaatctccgggcttaactcggaaaggtcaactgatactgtgcgactagagtgcggaaggggcaactggaattctcggtgtagcggtgaaatgcgtagatatcgagaggaacacctgcggcgaaggcgggttgctgggccgacactgacgctgatgcgcgaaagccaggggagcgaacggg

SEQ ID NO: 27 - DNA, 255 bp, Unknown
  Kingdom: Bacteria, Phylum: Acidobacteria, Class: Acidobacteria, Order: Subgroup_4, Family: RB41, Genus:
atacggggggagcaagcgttgttcggatttactgggcgtaaagggcgcgtaggcggccactgcaagtcagttgtgaaatctccgggcttaacccggaaaggtcaactgatactgcagggctagagtgcagaaggggcaactggaattctcggtgtagcggtgaaatgcgtagatatcgagaggaacacctgcggcgaaggcgggttgctgggctgacactgacgctgaggcgcgaaagccaggggagcgaacggg

SEQ ID NO: 28 - DNA, 255 bp, Unknown
  Kingdom: Bacteria, Phylum: Acidobacteria, Class: Acidobacteria, Order: Subgroup_4, Family: RB41, Genus:
atacggggggagcaagcgttgttcggatttactgggcgtaaagggcgcgtaggcggccaccgcaagtcgactgtgaaatctccgggcttaactcggaaaggtcagccgatactgcggggctagagtgcagaaggggcaactggaattctcggtgtagcggtgaaatgcgtagatatcgagaggaacacctgcggcgaaggcgggttgctgggctgacactgacgctgaggcgcgaaagctaggggagcgaacggg

SEQ ID NO: 29 - DNA, 254 bp, Unknown
  Kingdom: Bacteria, Phylum: Acidobacteria, Class: Acidobacteria, Order: Subgroup_4, Family: Unknown_Family, Genus: Blastocatella
atacgtagggaccaagcgttgttcggatttactgggcgtaaagggcgcgtaggcggcgctgtaagtcacttgtgaaatctccgggcttaactcggaacggccaagtgatactgcagtgctagagtgcagaaggggcaatcggaattcttggtgtagcggtgaaatgcgtagatatcaagaggaacacctgaggtgaagacgggttgctgggctgacactgacgctgaggcgcgaaagccaggggagcaaacggg

SEQ ID NO: 30 - DNA, 255 bp, Unknown
  Kingdom: Bacteria, Phylum: Acidobacteria, Class: Acidobacteria, Order: Subgroup_4, Family: Unknown_Family, Genus:
atacgtagggaccaagcgttgttcggatttactgggcgtaaagggcgcgtaggcggcgtgacaagtcacttgtgaaatctccgggcttaacccggaacggtcaagtgatactgtcgtgctagagtgcagaaggggcaatcggaattcttggtgtagcggtgaaatgcgtagatatcaagaggaacacctgaggtgaagacgggttgctgggctgacactgacgctgacagcgcgaaagctaggggagcaaacggg

SEQ ID NO: 31 - DNA, 254 bp, Unknown
  Kingdom: Bacteria, Phylum: Acidobacteria, Class: Acidobacteria, Order: Subgroup_4, Family: Unknown_Family, Genus:
atacgtagggagcaagcgttgttcggatttactgggcgtaaagggcgcgtaggcggcgcagtaagtcacttgtgaaatctctgagcttaactcagaacggccaagtgatactgcagtgctagagtgcagaaggggcaatcggaattcttggtgtagcggtgaaatgcgtagatatcaagaggaacacctgaggtgaagacgggttgctaggctgacactgacgctgaggcgcgaaagccaggggagcaaacggg

SEQ ID NO: 32 - DNA, 254 bp, Unknown
  Kingdom: Bacteria, Phylum: Acidobacteria, Class: Acidobacteria, Order: Subgroup_4, Family: Unknown_Family, Genus:
atacgtagggaccaagcgttgttcggatttactgggcgtaaagggcgcgtaggcggcgtggtaagtcacttgtgaaatctccgagcttaactcggaacggtcaagtgatactgctgtgctagagtacagaaggggcaatcggaattcttggtgtagcggtgaaatgcgtagatatcaagaggaacacctgaggtgaagacgggttgctgggctgatactgacgctgaggcgcgaaagctagggtagcaaacggg

SEQ ID NO: 33 - DNA, 255 bp, Unknown
  Kingdom: Bacteria, Phylum: Acidobacteria, Class: Acidobacteria, Order: Subgroup_4, Family: Unknown_Family, Genus:
atacgtagggagcaagcgttgttcggatttactgggcgtaaagggcgcgtaggcggcaaattaagtcagctgtgaaatctccgagcttaactcggaactgtcagctgatactgatctgctagagtgcggaaggggcaatcggaattcttggtgtagcggtgaaatgcgtagatatcaagaggaacacctgaggtgaagacgggttgctgggccgacactgacgctgagtgcgcgaaagccaggggagcaaacggg

SEQ ID NO: 34 - DNA, 254 bp, Unknown
  Kingdom: Bacteria, Phylum: Acidobacteria, Class: Acidobacteria, Order: Subgroup_4, Family: Unknown_Family, Genus:
atacgtagggagcaagcgttgttcggatttactgggcgtaaagggcgcgtaggcggcgcggtaagtcacttgtgaaatctctgagcttaactcagaacggccaagtgatactgcagtgctagagtgcagaaggggcaatcggaattcttggtgtagcggtgaaatgcgtagatatcaagaggaacacctgaggtgaagacgggttgctgggctgacactgacgctgaggcgcgaaagccaggggagcaaacggg

SEQ ID NO: 35 - DNA, 254 bp, Unknown
  Kingdom: Bacteria, Phylum: Acidobacteria, Class: Acidobacteria, Order: Subgroup_4, Family: Unknown_Family, Genus:
atacgtagggaccaagcgttgttcggatttactgggcgtaaagggcgcgtaggcggcaattcaagtcagctgtgaaatctccgggcttaactcggaacggtcagctgatactgctttgctagagtgcagaaggggcaatcggaattcttggtgtagcggtgaaatgcgtagatatcaagaggaacacctgaggtgaagacgggttgctgggctgacactgacgctgaggcgcgaaagctagggtagcaaacggg

SEQ ID NO: 36 - DNA, 254 bp, Unknown
  Kingdom: Bacteria, Phylum: Acidobacteria, Class: Acidobacteria, Order: Subgroup_6, Family:  , Genus:
atacagagggggcaagcgttgttcggaattactgggcgtaaagggcgcgtaggcggccgcctaagtcagacgtgaaatccctcggctcaaccggggaactgcgtctgatactgggtggcttgaatccgggagagggatgcggaattccaggtgtagcggtgaaatgcgtagatatctggaggaacaccggtggcgaaggcggcatcctggaccggcattgacgctgaggcgcgaaagccaggggagcaaacggg

SEQ ID NO: 37 - DNA, 254 bp, Unknown
  Kingdom: Bacteria, Phylum: Acidobacteria, Class: Acidobacteria, Order: Subgroup_6, Family:  , Genus:
atacggggggggcaagcgttgttcggaattactgggcgtaaagggctcgtaggtggccaactaagtcagacgtgaaatccctcggcttaaccggggaactgcgtctgatactggatggcttgagtttgggagagggatgcggaattccaggtgtagcggtgaaatgcgtagatatctggaggaacaccggtggcgaaggcggcatcctggaccaacactgacactgaggagcgaaagccaggggagcaaacggg

SEQ ID NO: 38 - DNA, 254 bp, Unknown
  Kingdom: Bacteria, Phylum: Acidobacteria, Class: Acidobacteria, Order: Subgroup_6, Family:  , Genus:
atacagagggggcaagcgttgttcggaattactgggcgtaaagggcgcgtaggcggcctgttaagtcgaacgtgaaatccccgggctcaacccgggaactgcgtccgatactggcaggcttgaattcgggagagggatgcggaattccaggtgtagcggtgaaatgcgtagatatctggaggaacaccggtggcgaaggcggcatcctggaccgagattgacgctgaggcgcgaaagccaggggagcaaacggg

SEQ ID NO: 39 - DNA, 254 bp, Unknown
  Kingdom: Bacteria, Phylum: Acidobacteria, Class: Acidobacteria, Order: Subgroup_6, Family:  , Genus:
atacagagggggcaagcgttgttcggaattactgggcgtaaagggcgcgtaggcggcctgctaagtcgaacgtgaaatccctgggctcaacccaggaactgcgtccgatactggttggcttgaattcgggagagggatgcggaattccaggtgtagcggtgaaatgcgtagatatctggaggaacaccggtggcgaaggcggcatcctggaccgatattgacgctgatgcgcgaaagccaggggagcaaacggg

SEQ ID NO: 40 - DNA, 255 bp, Unknown
  Kingdom: Bacteria, Phylum: Acidobacteria, Class: Acidobacteria, Order: Subgroup_6, Family:  , Genus:
atacggggggggcaagcgttgttcggaattactgggcgtaaagggctcgtaggcggccaactaagtccgacgtgaaatccccaggcttaacctgggaactgcgtcggatactggatggcttgaattcgggagagggatgcagaattccaggtgtagcggtgaaatgcgtagatatctggaggaataccgggtggcgaaggcggcatcctggaccgacattgacgctgatgagcgaaagctaggggagcaaacggg

SEQ ID NO: 41 - DNA, 254 bp, Unknown
  Kingdom: Bacteria, Phylum: Acidobacteria, Class: Acidobacteria, Order: Subgroup_6, Family:  , Genus:
atacagggggggcaagcgttgttcggaattactgggcgtaaagggctcgtaggtggccaactaagtcagacgtgaaatccctcagcttaactggggaactgcgtctgatactggatggcttgagtttgggagagggatgcggaattccaggtgtagcggtgaaatgcgtagatatctggaggaacaccggtggcgaaggcggcatcctggaccaacactgacactgaggagcgaaagccaggggagcaaacggg

SEQ ID NO: 42 - DNA, 251 bp, Unknown
  Kingdom: Bacteria, Phylum: Acidobacteria, Class: Acidobacteria-6, Order: iii1-15, Family: RB40, Genus:
tacagggggggcaagcgttgttcggaattactgggcgtaaagggttcgtaggtggccgcttaagtcagacgtgaaatccctcagcttaactggggaactgcgtctgatactgggaggcttgagtgcaggagaggaacgcggaattccaggtgtagcggtgaaatgcgtagatatctggaggaacaccggtggcgaaggcggcgttctggactgactgacactgaggaacgaaagccaggggagcaaacggg

SEQ ID NO: 43 - DNA, 251 bp, Unknown
  Kingdom: Bacteria, Phylum: Acidobacteria, Class: Acidobacteriia, Order: Acidobacteriales, Family: Acidobacteriaceae, Genus:
tacgaggggggcaagcgttgttcggaattattgggcgtaaagggcgcgtaggcggtttgacaagtctgatgtgaaatctctgggctcaacccagagtctgcattagaaactgtcgggcttgagtatgggagaggtgagtggaatttccggtgtagcggtgaaatgcgtagatatcggaaggaacacctgtggcgaaagcggctcactggaccaactgacgctgaggcgcgaaagctaggggagcaaacagg

SEQ ID NO: 44 - DNA, 251 bp, Unknown
  Kingdom: Bacteria, Phylum: Acidobacteria, Class: Acidobacteriia, Order: Acidobacteriales, Family: Acidobacteriaceae, Genus:
tacgaggggggcaagcgttgttcggaattattgggcgtaaagggcgcgtaggcggtttggcaagtttggtgtgaaatcttcgggctcaactcgaagtctgcatcgaaaactgccgggcttgagtatgggagaggtgagtggaatttccggtgtagcggtgaaatgcgtagatatcggaaggaacacctgtggcgaaagcggctcactggaccaactgacgctgaggcgcgaaagctaggggagcaaacagg

SEQ ID NO: 45 - DNA, 251 bp, Unknown
  Kingdom: Bacteria, Phylum: Acidobacteria, Class: Acidobacteriia, Order: Acidobacteriales, Family: Koribacteraceae, Genus:
tacagagggtgcaagcgttgttcggaattattgggcgtaaagggcgcgtaggcggtgcggtaagtctgtagtgaaatctctgggctcaactcagagtctgctgcagaaactgccgtgcttgagtgtgggagaggtgagtggaattcccggtgtagcggtgaaatgcgtagatatcgggaggaacacctgtggcgaaagcggctcactggaccaactgacgctgaggcgcgaaagctaggggagcaaacagg

SEQ ID NO: 46 - DNA, 254 bp, Unknown
  Kingdom: Bacteria, Phylum: Acidobacteria, Class: Holophagae, Order: Subgroup_7, Family:  , Genus:
atacagagggggcaagcgttattcggaattattgggcgtaaagggcgcgtaggcggcttcgcaagtggaaggtgaaatccctcggcttaaccgaggaactgccctccaaactgcgttgcttgaggccgggagaggtgagtggaattcccagtgtagcggtgaaatgcgtagatattgggaggaacaccagtggcgaaggcggctcactggaccggttctgacgctgaggcgcgaaagcgtggggagcaaacggg

SEQ ID NO: 47 - DNA, 254 bp, Unknown
  Kingdom: Bacteria, Phylum: Acidobacteria, Class: Holophagae, Order: Subgroup_7, Family:  , Genus:
atacagagggggcaagcgttattcggaattattgggcgtaaagggcgcgtaggcggcttggcaagtggatggtgaaatccctcggcttaaccgaggaactgccgtccaaactgcttcgcttgagaccgggagaggtgagtggaattcccagtgtagcggtgaaatgcgtagatattgggaggaacaccagtggcgaaggcggctcactggaccggtactgacgctgatgcgcgaaagcgtggggagcaaacggg

SEQ ID NO: 48 - DNA, 251 bp, Unknown
  Kingdom: Bacteria, Phylum: Acidobacteria, Class: Solibacteres, Order: Solibacterales, Family: Solibacteraceae, Genus:
tacgtaggcagcaagcgttgttcggagttactgggcgtaaagggtgtgtaggcggttggataagtgtggtgtgaaatctcccggctcaactgggagggtgcgctacaaactgtctgactagagtgtgggatgggtaagtggaattcctggtgtagcggtgaaatgcgtagatatcaggaggaacaccggtggtgtagacggcttactggaccaactgacgctgagacacgaaagcgtgggtagcaaacagg

SEQ ID NO: 49 - DNA, 254 bp, Unknown
  Kingdom: Bacteria, Phylum: Actinobacteria, Class: Acidimicrobiia, Order: Acidimicrobiales, Family: Iamiaceae, Genus:
acacgtagggggcaagcgttgtccggatttattgggcgtaaagagctcgtaggtggctgagtaagtcggatgttaaatccccaggctcaacctgggacaccacccgatactgctctggctagagtccggtaggggagcgtggaattcctggtgtagcggtgaaatgcgcagatatcaggaggaacaccagcggcgaaggcggcgctctgggccggtactgacactgaggagcgaaagcgtgggtagcaaacagg

SEQ ID NO: 50 - DNA, 255 bp, Unknown
  Kingdom: Bacteria, Phylum: Actinobacteria, Class: Acidimicrobiia, Order: Acidimicrobiales, Family: Iamiaceae, Genus:
acacgtagggggcaagcgttgtccggattcattgggcgtaaagagctcgtaggcggttcgataagtcgggtgtgaaacctccaggctcaacctggagacgccacccgatactgtcgtgactagagtccagtaggggagcgtggaattcctggtgtagcggtgaaatgcgcagatatcaggaggaacaccagcggcgaaggcggcgctctgggctggaactgacgctgaggagcgaaagcgtggggagcgaacagg

SEQ ID NO: 51 - DNA, 255 bp, Unknown
  Kingdom: Bacteria, Phylum: Actinobacteria, Class: Acidimicrobiia, Order: Acidimicrobiales, Family:  , Genus:
acacgtagggggcgagcgttgtccggatttattgggcgtaaagagctcgtaggcggtttcgtaagtcggatgtgaaaactccaggctcaacttggagacgccattcgatactgcgatgacttgagtccggtaggggagtgtggaattcctggtgtagcggtgaaatgcgcagatatcaggaggaacaccggcggcgaaggcggcactctgggccggtactgacgctgaggagcgaaagcgtgggtagcaaacagg

SEQ ID NO: 52 - DNA, 255 bp, Unknown
  Kingdom: Bacteria, Phylum: Actinobacteria, Class: Acidimicrobiia, Order: Acidimicrobiales, Family:  , Genus:
atacgtagggggcaagcgttgtccggatttattgggcgtaaagagctcgtaggtggttcggtaagtcggatgtgaaatctccaggctcaacctggaggggtcattcgatactgccgtgactagaggtcggtaggggagtgtggaattcctggtggagcggtgaaatgcgcagatatcaggaggaacacccgtagcgaaggcggcactctgggccgatactgacactgaggagcgaaagcgtggggagcgaacagg

SEQ ID NO: 53 - DNA, 255 bp, Unknown
  Kingdom: Bacteria, Phylum: Actinobacteria, Class: Acidimicrobiia, Order: Acidimicrobiales, Family:  , Genus:
acacgtagggggcaagcgttgtccggatttattgggcgtaaagagctcgtaggtggttcggtaagtcaggtgtgaaacctccaggctcaacctggagacgccacttgatactgctgtgactggagtccggtaggggagcgtggaattcctggtgtagcggtgaaatgcgcagatatcaggaggaacaccagcggcgaaggcggcgctctgggccggtactgacactgaggagcgaaagcgtgggtagcaaacagg

SEQ ID NO: 54 - DNA, 251 bp, Unknown
  Kingdom: Bacteria, Phylum: Actinobacteria, Class: Actinobacteria, Order: Actinomycetales, Family: Cellulomonadaceae, Genus:
tacgtagggcgcaagcgttgtccggaattattgggcgtaaagagctcgtaggcggtttgtcgcgtctgctgtgaaatcctcaggctcaacctggggcttgcagtgggtacgggcagactagagtgcggtaggggtgactggaattcctggtgtagcggtggaatgcgcagatatcaggaggaacaccgatggcgaaggcaggtcactgggccgactgacgctgaggagcgaaagcatggggagcgaacagg

SEQ ID NO: 55 - DNA, 251 bp, Unknown
  Kingdom: Bacteria, Phylum: Actinobacteria, Class: Actinobacteria, Order: Actinomycetales, Family: Frankiaceae, Genus:
tacgtagggtgcaagcgttgtccggaattattgggcgtaaagagctcgtaggcggtttgtcgcgtcggctgtgaaaacctggggctcaaccccgggcctgcagccgatacgggcaaactagaattcggtaggggagactggaattcctggtgtagcggtgaaatgcgcagatatcaggaggaacaccggtggcgaaggcgggtctctgggccgattgacgctgaggagcgaaagcgtggggagcaaacagg

SEQ ID NO: 56 - DNA, 251 bp, Unknown
  Kingdom: Bacteria, Phylum: Actinobacteria, Class: Actinobacteria, Order: Actinomycetales, Family: Intrasporangiaceae, Genus:
tacgtagggtgcgagcgttgtccggaattattgggcgtaaagagcttgtaggcggtttgtcgcgtctgctgtgaaatttcggggcttaaccccgaacttgcagtgggtacgggcagactagagtgtggtaggggagactggaattcctggtgtagcggtgaaatgcgcagatatcaggaggaacaccgatggcgaaggcaggtctctgggccaactgacgctgagaagcgaaagcatggggagcgaacagg

SEQ ID NO: 57 - DNA, 251 bp, Unknown
  Kingdom: Bacteria, Phylum: Actinobacteria, Class: Actinobacteria, Order: Actinomycetales, Family: Kineosporiaceae, Genus:
tacgtagggtgcaagcgttgtccggaattattgggcgtaaagagctcgtaggcggtgtgtcgcgtctgctgtgaaaactcagggctcaactctgagcttgcagtgggtacgggcacacttgagtgctgtaggggagactggaattcctggtgtagcggtgaaatgcgcagatatcaggaggaacaccggtggcgaaggcgggtctctgggcagactgacgctgaggagcgaaagcatggggagcgaacagg

SEQ ID NO: 58 - DNA, 251 bp, Unknown
  Kingdom: Bacteria, Phylum: Actinobacteria, Class: Actinobacteria, Order: Actinomycetales, Family: Microbacteriaceae, Genus:
tacgtagggtgcgagcgttatccggaattattgggcgtaaagagctcgtaggcggtttgtcacgtctgctgtggaaactggaggctcaaccttcagcctgcagtgggtacgggcagactagagtgcggtaggggagattggaattcctggtgtagcggtggaatgcgcagatatcaggaggaacaccgatggcgaaggcagatctctgggccgactgacgctgaggagcgaaagcgtggggagcgaacagg

SEQ ID NO: 59 - DNA, 251 bp, Unknown
  Kingdom: Bacteria, Phylum: Actinobacteria, Class: Actinobacteria, Order: Actinomycetales, Family: Microbacteriaceae, Genus:
tacgtagggtgcgagcgttgtccggaattattgggcgtaaagagctcgtaggcggtctgtcgcgtctgctgtgaaatcccgaggctcaacctcgggcctgcagtgggtacgggcagactagagtgcggtaggggagattggaattcctggtgtagcggtggaatgcgcagatatcaggaggaacaccgatggcgaaggcagatctctgggccgactgacgctgaggagcgaaagcgtggggagcgaacagg

SEQ ID NO: 60 - DNA, 251 bp, Unknown
  Kingdom: Bacteria, Phylum: Actinobacteria, Class: Actinobacteria, Order: Actinomycetales, Family: Micrococcaceae, Genus:
tacgtagggcgcaagcgttatccggaattattgggcgtaaagagctcgtaggcggtttgtcgcgtctgctgtgaaagaccggggctcaactccggttctgcagtgggtacgggcagactagagtgatgtaggggagactggaattcctggtgtagcggtgaaatgcgcagatatcaggaggaacaccgatggcgaaggcaggtctctgggcatactgacgctgaggagcgaaagcatggggagcgaacagg

SEQ ID NO: 61 - DNA, 251 bp, Unknown
  Kingdom: Bacteria, Phylum: Actinobacteria, Class: Actinobacteria, Order: Actinomycetales, Family: Micrococcaceae, Genus:
tacgtagggcgcaagcgttatccggaattattgggcgtaaagagctcgtaggcggtttgtcgcgtctgctgtgaaagcccggggctcaaccccgggtctgcagtgggtacgggcagactagagtgcagtaggggagactggaattcctggtgtagcggtgaaatgcgcagatatcaggaggaacaccgatggcgaaggcaggtctctgggctgactgacgctgaggagcgaaagcatggggagcgaacagg

SEQ ID NO: 62 - DNA, 251 bp, Unknown
  Kingdom: Bacteria, Phylum: Actinobacteria, Class: Actinobacteria, Order: Actinomycetales, Family: Streptomycetaceae, Genus:
tacgtagggtgcgagcgttgtccggaattattgggcgtaaagagctcgtaggcggcttgtcgcgtcggatgtgaaagcccggggcttaactccgggtctgcattcgatacgggcaggctagagttcggtaggggagatcggaattcctggtgtagcggtgaaatgcgcagatatcaggaggaacaccggtggcgaaggcggatctctgggccgactgacgctgaggagcgaaagcgtggggagcgaacagg

SEQ ID NO: 63 - DNA, 251 bp, Unknown
  Kingdom: Bacteria, Phylum: Actinobacteria, Class: Actinobacteria, Order: Actinomycetales, Family:  , Genus:
tacgtagggtgcaagcgttgtccggaattattgggcgtaaagagctcgtaggcggctcgtcgcgtctgctgtgaaagcccggggcttaaccccgggtctgcagtgggtacgggcgggctagagtgcggtaggggagactggaattcctggtgtagcggtgaaatgcgcagatatcaggaggaacaccggtggcgaaggcgggtctctgggccgactgacgctgaggagcgaaagcatgggtagcgaacagg

SEQ ID NO: 64 - DNA, 255 bp, Unknown
  Kingdom: Bacteria, Phylum: Actinobacteria, Class: Actinobacteria, Order: Corynebacteriales, Family: Corynebacteriaceae, Genus:
atacgtagggtgcgagcgttgtccggaattactgggcgtaaagggctcgtaggtggtttgtcgcgtcgtctgtgaaattccggggcttaactccgggcgtgcaggcgatacgggcataacttgagtactgtaggggtaactggaattcctggtgtagcggtgaaatgcgcagatatcaggaggaacaccgatggcgaaggcaggttactgggcagttactgacgctgaggagcgaaagcatgggtagcgaacagg

SEQ ID NO: 65 - DNA, 255 bp, Unknown
  Kingdom: Bacteria, Phylum: Actinobacteria, Class: Actinobacteria, Order: Corynebacteriales, Family: Corynebacteriaceae, Genus:
atacgtagggtgcgagcgttgtccggaattactgggcgtaaagagctcgtaggtggtttgtcgcgtcgtttgtgtaagcccgcagcttaactgcgggactgcaggcgatacgggcataacttgagtgctgtaggggagactggaattcctggtgtagcggtggaatgcgcagatatcaggaggaacaccgatggcgaaggcaggtctctgggcagtaactgacgctgaggagcgaaagcatgggtagcgaacagg

SEQ ID NO: 66 - DNA, 254 bp, Unknown
  Kingdom: Bacteria, Phylum: Actinobacteria, Class: Actinobacteria, Order: Corynebacteriales, Family: Corynebacteriaceae, Genus:
atacgtagggtgcgagcgttgtccggaattactgggcgtaaagagctcgtaggcggtttgtcacgtcgtctgtgaaatcctagggcttaaccctggacgtgcaggcgatacgggctgacttgagtactacaggggagactggaatttctggtgtagcggtggaatgcacagatatcaggaagaacaccgatggcgaaggcaggtctctgggtagtaactgacgctgaggagcgaaagcatgggtagcgaacagg

SEQ ID NO: 67 - DNA, 255 bp, Unknown
  Kingdom: Bacteria, Phylum: Actinobacteria, Class: Actinobacteria, Order: Corynebacteriales, Family: Corynebacteriaceae, Genus:
atacgtagggtgcgagcgttgtccggaattactgggcgtaaagagctcgtaggtggtttgtcgcgtcgtttgtgtaagcccgcagcttaactgcgggactgcaggcgatacgggcataacttgagtgctgtaggggagactggaattcctggtgtagcggtggaatgcgcagatatcaggaggaacaccgatggcgaaggcaggtctctgggcagtaactgacgctgaggagcgaaagcatggggagcgaacagg

SEQ ID NO: 68 - DNA, 255 bp, Unknown
  Kingdom: Bacteria, Phylum: Actinobacteria, Class: Actinobacteria, Order: Corynebacteriales, Family: Corynebacteriaceae, Genus:
atacgtagggtgcgagcgttgtccggaattactgggcgtaaagagctcgtaggtggtttgtcgcgtcgtttgtggaataccgcagcttaactgcggggttgcaggcgatacgggcataacttgagtgctgtaggggagactggaattcctggtgtagcggtggaatgcgcagatatcaggaggaacaccgatggcgaaggcaggtctctgggcagtaactgacgctgaggagcgaaagcatgggtagcgaacagg

SEQ ID NO: 69 - DNA, 254 bp, Unknown
  Kingdom: Bacteria, Phylum: Actinobacteria, Class: Actinobacteria, Order: Corynebacteriales, Family: Mycobacteriaceae, Genus:
atacgtagggtccgagcgttgtccggaattactgggcgtaaagagctcgtaggtggtttgtcgcgttgttcgtgaaaactcacagcttaactgtgggcgtgcgggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtggggagcgaacagg

SEQ ID NO: 70 - DNA, 254 bp, Unknown
  Kingdom: Bacteria, Phylum: Actinobacteria, Class: Actinobacteria, Order: Corynebacteriales, Family: Mycobacteriaceae, Genus:
atacgtagggtgcgagcgttgtccggaattactgggcgtaaagagctcgtaggtggtttgtcgcgttgttcgtgaaatctcacggcttaactgtgagcgtgcgggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtggggagcgaacagg

SEQ ID NO: 71 - DNA, 254 bp, Unknown
  Kingdom: Bacteria, Phylum: Actinobacteria, Class: Actinobacteria, Order: Corynebacteriales, Family: Mycobacteriaceae, Genus:
atacgtagggtgcgagcgttgtccggaattactgggcgtaaagagctcgtaggtggtttgtcgcgttgttcgtgaaaactcacagcttaactgtgggcgtgcgggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtggggagcgaacagg

SEQ ID NO: 72 - DNA, 254 bp, Unknown
  Kingdom: Bacteria, Phylum: Actinobacteria, Class: Actinobacteria, Order: Corynebacteriales, Family: Mycobacteriaceae, Genus:
atacgtagggtccgagcgttgtccggaattactgggcgtaaagagctcgtaggtggtttgtcgcgttgttcgtgaaaactcacagctcaactgtgggcgtgcgggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtggggagcgaacagg

SEQ ID NO: 73 - DNA, 254 bp, Unknown
  Kingdom: Bacteria, Phylum: Actinobacteria, Class: Actinobacteria, Order: Corynebacteriales, Family: Mycobacteriaceae, Genus:
atacgtagggtgcgagcgttgtccggaattactgggcgtaaagagctcgtaggtggtttgtcgcgttgttcgtgaaatctcacggcttaactgtgagcgtgcgggcgatacgggcagacttgagtactgcaggggagactggaattcctggtgtagcggtggaatgcgcagatatcaggaggaacaccggtggcgaaggcgggtctctgggcagtaactgacgctgaggagcgaaagcgtggggagcgaacagg

SEQ ID NO: 74 - DNA, 254 bp, Unknown
  Kingdom: Bacteria, Phylum: Actinobacteria, Class: Actinobacteria, Order: Corynebacteriales, Family: Mycobacteriaceae, Genus:
atacgtagggtccgagcgttgtccggaattactgggcgtaaagagctcgtaggtggtttgtcgcgttgttcgtgaaaactcacagcttaactgtgggcgtgcgggcgatacgggcagacttgagtactgcaggggagactggaattcctggtgtagcggtggaatgcgcagatatcaggaggaacaccggtggcgaaggcgggtctctgggcagtaactgacgctgaggagcgaaagcgtggggagcgaacagg

SEQ ID NO: 75 - DNA, 254 bp, Unknown
  Kingdom: Bacteria, Phylum: Actinobacteria, Class: Actinobacteria, Order: Corynebacteriales, Family: Mycobacteriaceae, Genus:
atacgtagggtccgagcgttgtccggaattactgggcgtaaagagctcgtaggtggtttgtcgcgttgttcgtgaaaactcacagcttaactgtgggcgtgcgggcgatacgggcagactggagtactgcaggggagactggaattcctggtgtagcggtggaatgcgcagatatcaggaggaacaccggtggcgaaggcgggtctctgggcagtaactgacgctgaggagcgaaagcgtggggagcgaacagg

SEQ ID NO: 76 - DNA, 254 bp, Unknown
  Kingdom: Bacteria, Phylum: Actinobacteria, Class: Actinobacteria, Order: Corynebacteriales, Family: Mycobacteriaceae, Genus:
atacgtagggtgcgagcgttgtccggaattactgggcgtaaagagctcgtaggtggtttgtcgcgttgttcgtgaaaactcacagcttaactgtgggcgtgcgggcgatacgggcagacttgagtactgcaggggagactggaattcctggtgtagcggtggaatgcgcagatatcaggaggaacaccggtggcgaaggcgggtctctgggcagtaactgacgctgaggagcgaaagcgtggggagcgaacagg

SEQ ID NO: 77 - DNA, 254 bp, Unknown
  Kingdom: Bacteria, Phylum: Actinobacteria, Class: Actinobacteria, Order: Corynebacteriales, Family: Mycobacteriaceae, Genus:
atacgtagggtgcgagcgttgtccggaattactgggcgtaaagagctcgtaggtggtttgtcgcgttgttcgtgaaaactcacagcttaactgtgggcgtgcgggcgatacgggcagactggagtactgcaggggagactggaattcctggtgtagcggtggaatgcgcagatatcaggaggaacaccggtggcgaaggcgggtctctgggcagtaactgacgctgaggagcgaaagcgtggggagcgaacagg

SEQ ID NO: 78 - DNA, 254 bp, Unknown
  Kingdom: Bacteria, Phylum: Actinobacteria, Class: Actinobacteria, Order: Corynebacteriales, Family: Nocardiaceae, Genus:
atacgtagggtgcgagcgttgtccggaattactgggcgtaaagagttcgtaggcggtttgtcgcgtcgtttgtgaaaacccggggctcaacttcgggcttgcaggcgatacgggcagacttgagtgtttcaggggagactggaattcctggtgtagcggtgaaatgcgcagatatcaggaggaacaccggtggcgaaggcgggtctctgggaaacaactgacgctgaggaacgaaagcgtgggtagcaaacagg

SEQ ID NO: 79 - DNA, 254 bp, Unknown
  Kingdom: Bacteria, Phylum: Actinobacteria, Class: Actinobacteria, Order: Corynebacteriales, Family: Nocardiaceae, Genus:
atacgtagggtgcgagcgttgtccggaattactgggcgtaaagagcttgtaggcggtctgtcacgtcttctgtgaaaacttggggctcaaccttaagcttgcaggggatacgggcagactagagtacttcaggggagactggaattcctggtgtagcggtgaaatgcgcagatatcaggaggaacaccggtggcgaaggcgggtctctgggaagtaactgacgctgagaagcgaaagcatgggtagcaaacagg

SEQ ID NO: 80 - DNA, 254 bp, Unknown
  Kingdom: Bacteria, Phylum: Actinobacteria, Class: Actinobacteria, Order: Corynebacteriales, Family: Nocardiaceae, Genus:
atacgtagggtgcaagcgttgtccggaattactgggcgtaaagagctcgtaggcggtttgtcgcgtcgtctgtgaaaactcgaggctcaacctcgagcttgcaggcgatacgggcagacttgagtactgcaggggagactggaattcctggtgtagcggtgaaatgcgcagatatcaggaggaacaccggtggcgaaggcgggtctctgggcagtaactgacgctgaggagcgaaagcgtgggtagcgaacagg

SEQ ID NO: 81 - DNA, 254 bp, Unknown
  Kingdom: Bacteria, Phylum: Actinobacteria, Class: Actinobacteria, Order: Corynebacteriales, Family: Segniliparaceae, Genus:
atacgtagggtgcgagcgttgttcggaattactgggcgtaaagagctcgtaggcggactgtcgcgtcgcctgtgaaagcccgtggctcaaccacgggtctgcaggcgatacgggcagactagagtactgcaggggagactggaattcctggtgtagcggtggaatgcgcagatatcaggaggaacaccggtggcgaaggcgggtctctgggcagtaactgacgctgaggagcgaaagcgtggggagcgaacagg

SEQ ID NO: 82 - DNA, 254 bp, Unknown
  Kingdom: Bacteria, Phylum: Actinobacteria, Class: Actinobacteria, Order: Frankiales, Family: Acidothermaceae, Genus:
acacgtagggcgcaagcgttgtccggaattattgggcgtaaagagctcgtaggcggtctgttgcgtccgctgtgaaaactcggggcttaaccccgagcctgcagtggatacgggcagactagaggtaggtaggggagaatggaattcccggtgtagcggtgaaatgcgcagatatcgggaggaacaccggtggcgaaggcggttctctgggccttacctgacgctgaggagcgaaagcgtggggagcgaacagg

SEQ ID NO: 83 - DNA, 254 bp, Unknown
  Kingdom: Bacteria, Phylum: Actinobacteria, Class: Actinobacteria, Order: Frankiales, Family: Geodermatophilaceae, Genus:
atacgtagggtgcaagcgttgtccggaattattgggcgtaaagagctcgtaggcggtctgtcacgtcggctgtgaaaacccgaggctcaacctcgggcctgcagtcgatacgggcaaactagagtactgcaggggagactggaattcctggtgtagcggtgaaatgcgcagatatcaggaggaacaccggtggcgaaggcgggtctctgggcagtaactgacgctgaggagcgaaagcgtggggagcgaacagg

SEQ ID NO: 84 - DNA, 254 bp, Unknown
  Kingdom: Bacteria, Phylum: Actinobacteria, Class: Actinobacteria, Order: Frankiales, Family: Geodermatophilaceae, Genus:
atacgtagggtgcaagcgttgtccggaattattgggcgtaaagagctcgtaggcggtttgtcgcgtcggctgtgaaagcccggagctcaactccgggtctgcagtcgatacgggcagacttgagtgttgcaggggagactggaattcctggtgtagcggtgaaatgcgcagatatcaggaggaacaccggtggcgaaggcgggtctctgggcaacaactgacgctgaggagcgaaagcgtggggagcgaacagg

SEQ ID NO: 85 - DNA, 254 bp, Unknown
  Kingdom: Bacteria, Phylum: Actinobacteria, Class: Actinobacteria, Order: Frankiales, Family: Geodermatophilaceae, Genus:
atacgtagggtgcaagcgttgtccggaattattgggcgtaaagagctcgtaggcggtctgtcgcgtcggctgtgaaaacccggagctcaactccgggcctgcagtcgatacgggcaaactggagtgttgcaggggagactggaattcctggtgtagcggtgaaatgcgcagatatcaggaggaacaccggtggcgaaggcgggtctctgggcaacaactgacgctgaggagcgaaagcgtggggagcgaacagg

SEQ ID NO: 86 - DNA, 254 bp, Unknown
  Kingdom: Bacteria, Phylum: Actinobacteria, Class: Actinobacteria, Order: Frankiales, Family: Nakamurellaceae, Genus: Nakamurella
atacgtagggtgcgagcgttgtccggaatcattgggcgtaaagagctcgtaggcggttcgtcgcgtcgaatgtgaaatcccggggctcaactccgggtctgcattcgatacgggcggactagagttcggtaggggagactggaattcctggtgtagcggtgaaatgcgcagatatcaggaggaacaccggtggcgaaggcgggtctctgggccgatactgacgctgaggagcgaaagcgtggggagcgaacagg

SEQ ID NO: 87 - DNA, 254 bp, Unknown
  Kingdom: Bacteria, Phylum: Actinobacteria, Class: Actinobacteria, Order: Frankiales, Family: Sporichthyaceae, Genus:
atacgtagggtgcaagcgttgtccggaattattgggcgtaaagagctcgtaggcggcttgtcacgtctgctgtgaaaactcggggctcaaccccgagcctgcagtggatacgggctagctagagtgcggtaggggagactggaattcctggtgtagcggtgaaatgcgcagatatcaggaggaacaccggtggcgaaggcgggtctctggaccgatactgacgctgaggagcgaaagcgtggggagcgaacagg

SEQ ID NO: 88 - DNA, 254 bp, Unknown
  Kingdom: Bacteria, Phylum: Actinobacteria, Class: Actinobacteria, Order: Frankiales, Family:  , Genus:
atacgtagggtgcaagcgttgtccggaattattgggcgtaaagagctcgtaggcggtctgtcgcgtcggctgtgaaaactcggggctcaaccccgagcctgcagtcgatacgggcagactagagtgctgtaggggagactggaattcctggtgtagcggtgaaatgcgcagatatcaggaggaacaccggtggcgaaggcgggtctctgggcagtaactgacgctgaggagcgaaagcgtggggagcgaacagg

SEQ ID NO: 89 - DNA, 254 bp, Unknown
  Kingdom: Bacteria, Phylum: Actinobacteria, Class: Actinobacteria, Order: Glycomycetales, Family: Glycomycetaceae, Genus:
agacgtagggcgcgagcgttgtccggatttattgggcgtaaagggctcgtaggcggttgattgcgtccgccgtgaaaggcctcggcttaaccggggttttgcggtggatacgggtcgacttgaggcaattaggggagatcggaattctacgtgtagcggtgaaatgcgcagatatgtggaggaacaccggtggcgaaggcggatctctgggattgttctgacgctgaggagcgaaagcgtggggagcgaacagg

SEQ ID NO: 90 - DNA, 254 bp, Unknown
  Kingdom: Bacteria, Phylum: Actinobacteria, Class: Actinobacteria, Order: Kineosporiales, Family: Kineosporiaceae, Genus:
atacgtagggtgcaagcgttgtccggaattattgggcgtaaagagctcgtaggcggtttgtcgcgtctgctgtgaaaactcggggcttaactccgggcctgcagtgggtacgggcagactagagtgcggtaggggagactggaattcctggtgtagcggtgaaatgcgcagatatcaggaggaacaccggtggcgaaggcgggtctctgggccgtaactgacgctgaggagcgaaagcgtggggagcgaacagg

SEQ ID NO: 91 - DNA, 254 bp, Unknown
  Kingdom: Bacteria, Phylum: Actinobacteria, Class: Actinobacteria, Order: Kineosporiales, Family: Kineosporiaceae, Genus:
atacgtagggtgcaagcgttgtccggaattattgggcgtaaagagctcgtaggcggtctgtcgcgtctgctgtgaaaactcagggcttaaccctgagcttgcagtgggtacgggcagactagagtgcggtaggggagactggaattcctggtgtagcggtgaaatgcgcagatatcaggaggaacaccggtggcgaaggcgggtctctgggccgtaactgacgctgaggagcgaaagcatggggagcgaacagg

SEQ ID NO: 92 - DNA, 254 bp, Unknown
  Kingdom: Bacteria, Phylum: Actinobacteria, Class: Actinobacteria, Order: Kineosporiales, Family: Kineosporiaceae, Genus:
atacgtagggtgcaagcgttgtccggaattattgggcgtaaagagctcgtaggcggtgtgtcgcgtctgctgtgaaaactcagggctcaactctgagcttgcagtgggtacgggcacacttgagtgctgtaggggagactggaattcctggtgtagcggtgaaatgcgcagatatcaggaggaacaccggtggcgaaggcgggtctctgggcagttactgacgctgaggagcgaaagcatggggagcgaacagg

SEQ ID NO: 93 - DNA, 254 bp, Unknown
  Kingdom: Bacteria, Phylum: Actinobacteria, Class: Actinobacteria, Order: Kineosporiales, Family: Kineosporiaceae, Genus:
atacgtagggtgcaagcgttgtccggaattattgggcgtaaagagctcgtaggcggtttgtcgcgtctgctgtgaaaatccagggcttaaccctggacctgcagtgggtacgggcagactagagtgcggtaggggagatcggaattcctggtgtagcggtgaaatgcgcagatatcaggaggaacaccggtggcgaaggcggatctctgggccgtaactgacgctgaggagcgaaagcatggggagcgaacagg

SEQ ID NO: 94 - DNA, 254 bp, Unknown
  Kingdom: Bacteria, Phylum: Actinobacteria, Class: Actinobacteria, Order: Kineosporiales, Family: Kineosporiaceae, Genus:
atacgtagggtgcaagcgttgtccggaattattgggcgtaaagagctcgtaggcggtttgtcgcgtctgctgtgaaaacgcggggctcaactccgcgcctgcagtgggtacgggcagactagagtgcagtaggggagactggaattcctggtgtagcggtggaatgcgcatatatcaggaggaacaccggtggcgaaggcgggtctctgggctgtaactgacgctgaggagcgaaagcgtgggtagcgaacagg

SEQ ID NO: 95 - DNA, 254 bp, Unknown
  Kingdom: Bacteria, Phylum: Actinobacteria, Class: Actinobacteria, Order: Kineosporiales, Family: Kineosporiaceae, Genus:
atacgtagggtgcaagcgttgtccggaattattgggcgtaaagagctcgtaggcggtgtgtcgcgtctgctgtgaaaactcagggctcaactctgagcttgcagtgggtacgggcacactagagtgctgtaggggagactggaattcctggtgtagcggtgaaatgcgcagatatcaggaggaacaccggtggcgaaggcgggtctctgggcagttactgacgctgaggagcgaaagcatggggagcgaacagg

SEQ ID NO: 96 - DNA, 254 bp, Unknown
  Kingdom: Bacteria, Phylum: Actinobacteria, Class: Actinobacteria, Order: Micrococcales, Family: Brevibacteriaceae, Genus:
atacgtagggtacaagcgttgtccggaattattgggcgtaaagagctcgtaggtggttggtcacgtctgctgtggaaacgcaacgcttaacgttgcgcgtgcagtgggtacgggctgactagagtgcagtaggggagtctggaattcctggtgtagcggtgaaatgcgcagatatcaggaggaacaccggtggcgaaggcgggactctgggctgtaactgacactgaggagcgaaagcatggggagcgaacagg

SEQ ID NO: 97 - DNA, 254 bp, Unknown
  Kingdom: Bacteria, Phylum: Actinobacteria, Class: Actinobacteria, Order: Micrococcales, Family: Cellulomonadaceae, Genus:
atacgtagggcgcaagcgttgtccggaattattgggcgtaaagagctcgtaggcggtttgtcgcgtctgctgtgaaaacctaaggctcaaccttgggcttgcagtgggtacgggcagactagagtgcggtaggggtgactggaattcctggtgtagcggtggaatgcgcagatatcaggaggaacaccgatggcgaaggcaggtcactgggccgcaactgacgctgaggagcgaaagcatggggagcgaacagg

SEQ ID NO: 98 - DNA, 254 bp, Unknown
  Kingdom: Bacteria, Phylum: Actinobacteria, Class: Actinobacteria, Order: Micrococcales, Family: Cellulomonadaceae, Genus:
atacgtagggcgcaagcgttgtccggaattattgggcgtaaagagctcgtaggcggtttgtcgcgtctgctgtgaaaacctgaggctcaacctcgggcttgcagtgggtacgggcagactagagtgcggtaggggtgactggaattcctggtgtagcggtggaatgcgcagatatcaggaggaacaccgatggcgaaggcaggtcactgggccgcaactgacgctgaggagcgaaagcatggggagcgaacagg

SEQ ID NO: 99 - DNA, 254 bp, Unknown
  Kingdom: Bacteria, Phylum: Actinobacteria, Class: Actinobacteria, Order: Micrococcales, Family: Dermabacteraceae, Genus:
atacgtagggcgcaagcgttgtccggaattattgggcgtaaagagcttgtaggtggcttgtcgcgtctgccgtgaaaacccgaggctcaacctcgggcgtgcggtgggtacgggcaggctagagtgtggtaggggagactggaactcctggtgtagcggtgaaatgcgcagatatcaggaagaacaccgatggcgaaggcaggtctctgggccattactgacactgagaagcgaaagcatgggtagcgaacagg

SEQ ID NO: 100 - DNA, 254 bp, Unknown
  Kingdom: Bacteria, Phylum: Actinobacteria, Class: Actinobacteria, Order: Micrococcales, Family: Dermabacteraceae, Genus:
atacgtagggcgcaagcgttgtccggaattattgggcgtaaagagctcgtaggtggcttgtcgcgtctgccgtgaaaacccgaggctcaacctcgggcgtgcggtgggtacgggcaggctagagtgtggtaggggagactggaactcctggtgtagcggtgaaatgcgcagatatcaggaagaacaccgatggcgaaggcaggtctctgggccattactgacactgaggagcgaaagcatgggtagcgaacagg

SEQ ID NO: 101 - DNA, 254 bp, Unknown
  Kingdom: Bacteria, Phylum: Actinobacteria, Class: Actinobacteria, Order: Micrococcales, Family: Dermacoccaceae, Genus:
atacgtagggtgcgagcgttgtccggaattattgggcgtaaagagcttgtaggcggtttgtcgcgtctgccgtgaaagcccagggcttaaccctgggtctgcggtgggtacgggcaggctagagtgtggtaggggagactggaattcctggtgtagcggtgaaatgcgcagatatcaggaggaacaccgatggcgaaggcaggtctctgggccactactgacgctgagaagcgaaagcatggggagcgaacagg

SEQ ID NO: 102 - DNA, 254 bp, Unknown
  Kingdom: Bacteria, Phylum: Actinobacteria, Class: Actinobacteria, Order: Micrococcales, Family: Dermacoccaceae, Genus:
atacgtagggtgcgagcgttgtccggaattattgggcgtaaagagcttgtaggcggtttgtcgcgtctgccgtgaaagcccagggcttaaccctgggtctgcggtgggtacgggcagactagagtgtggtaggggagactggaattcctggtgtagcggtgaaatgcgcagatatcaggaggaacaccgatggcgaaggcaggtctctgggccactactgacgctgagaagcgaaagcatggggagcaaacagg

SEQ ID NO: 103 - DNA, 254 bp, Unknown
  Kingdom: Bacteria, Phylum: Actinobacteria, Class: Actinobacteria, Order: Micrococcales, Family: Intrasporangiaceae, Genus:
atacgtagggtgcgagcgttgtccggaattattgggcgtaaagagcttgtaggcggtttgtcgcgtctgccgtgaaaattcgaggctcaacctcgaacttgcggtgggtacgggcagactagagtgtggtaggggagactggaattcctggtgtagcggtgaaatgcgcagatatcaggaggaacaccgatggcgaaggcaggtctctgggccactactgacgctgagaagcgaaagcatggggagcgaacagg

SEQ ID NO: 104 - DNA, 254 bp, Unknown
  Kingdom: Bacteria, Phylum: Actinobacteria, Class: Actinobacteria, Order: Micrococcales, Family: Microbacteriaceae, Genus:
atacgtagggtgcaagcgttgtccggaattattgggcgtaaagagctcgtaggcggtttgtcgcgtctgctgtgaaaacgcgaggctcaacctcgcgcctgcagtgggtacgggcagactagagtgcggtaggggagattggaattcctggtgtagcggtggaatgcgcagatatcaggaggaacaccgatggcgaaggcagatctctgggccgttactgacgctgaggagcgaaagcgtggggagcgaacagg

SEQ ID NO: 105 - DNA, 254 bp, Unknown
  Kingdom: Bacteria, Phylum: Actinobacteria, Class: Actinobacteria, Order: Micrococcales, Family: Microbacteriaceae, Genus:
atacgtagggtgcaagcgttgtccggaattattgggcgtaaagagctcgtaggcggtttgtcgcgtctgctgtgaaatctgggggctcaacccccagcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcatggggagcgaacagg

SEQ ID NO: 106 - DNA, 254 bp, Unknown
  Kingdom: Bacteria, Phylum: Actinobacteria, Class: Actinobacteria, Order: Micrococcales, Family: Microbacteriaceae, Genus:
atacgtagggtgcaagcgttgtccggaattattgggcgtaaagagctcgtaggcggtttgtcgcgtctgctgtgaaaacccgaggctcaacctcgggcctgcagtgggtacgggcagactagagtgcggtaggggagaatggaattcctggtgtagcggtggaatgcgcagatatcaggaggaacaccgatggcgaaggcagttctctgggccgtaactgacgctgaggagcgaaagcgtggggagcgaacagg

SEQ ID NO: 107 - DNA, 254 bp, Unknown
  Kingdom: Bacteria, Phylum: Actinobacteria, Class: Actinobacteria, Order: Micrococcales, Family: Microbacteriaceae, Genus:
atacgtagggtgcgagcgttgtccggaattattgggcgtaaagagctcgtaggcggtctgtcgcgtctgctgtgaaaacccgaggctcaacctcgggcctgcagtgggtacgggcagactagagtgcggtaggggagaatggaactcctggtgtagcggtggaatgcgcagatatcaggaagaacaccgatggcgaaggcagttctctgggccgtaactgacgctgaggagcgaaagcgtggggagcgaacagg

SEQ ID NO: 108 - DNA, 254 bp, Unknown
  Kingdom: Bacteria, Phylum: Actinobacteria, Class: Actinobacteria, Order: Micrococcales, Family: Microbacteriaceae, Genus:
atacgtagggtgcaagcgttatccggaattattgggcgtaaagagctcgtaggcggtttgtcgcgtctgctgtgaaaaccggaggctcaacctccggcctgcagtgggtacgggcaaactagagtgcggtaggggagattggaattcctggtgtagcggtggaatgcgcagatatcaggaggaacaccgatggcgaaggcagatctctgggccgtaactgacgctgaggagcgaaagcgtggggagcgaacagg

SEQ ID NO: 109 - DNA, 254 bp, Unknown
  Kingdom: Bacteria, Phylum: Actinobacteria, Class: Actinobacteria, Order: Micrococcales, Family: Microbacteriaceae, Genus:
atacgtagggtgcaagcgttatccggaattattgggcgtaaagagctcgtaggcggtttgtcgcgtctgctgtgaaaactggaggctcaacctccagcctgcagtgggtacgggcaaactagagtgcggtaggggagattggaattcctggtgtagcggtggaatgcgcagatatcaggaggaacaccgatggcgaaggcagatctctgggccgtaactgacgctgaggagcgaaagcatggggagcgaacagg

SEQ ID NO: 110 - DNA, 254 bp, Unknown
  Kingdom: Bacteria, Phylum: Actinobacteria, Class: Actinobacteria, Order: Micrococcales, Family: Microbacteriaceae, Genus:
atacgtagggtgcaagcgttgtccggaattattgggcgtaaagagctcgtaggcggtttgtcgcgtctgctgtgaaatctgggggctcaacccccagcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacagg

SEQ ID NO: 111 - DNA, 254 bp, Unknown
  Kingdom: Bacteria, Phylum: Actinobacteria, Class: Actinobacteria, Order: Micrococcales, Family: Microbacteriaceae, Genus:
atacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcatggggagcgaacagg

SEQ ID NO: 112 - DNA, 254 bp, Unknown
  Kingdom: Bacteria, Phylum: Actinobacteria, Class: Actinobacteria, Order: Micrococcales, Family: Microbacteriaceae, Genus:
atacgtagggtgcaagcgttatccggaattattgggcgtaaagagctcgtaggcggtttgtcacgtctgctgtgaaaactggaggctcaacctccagcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcatggggagcgaacagg

SEQ ID NO: 113 - DNA, 254 bp, Unknown
  Kingdom: Bacteria, Phylum: Actinobacteria, Class: Actinobacteria, Order: Micrococcales, Family: Microbacteriaceae, Genus:
atacgtagggtgcgagcgttgtccggaattattgggcgtaaagagctcgtaggcggtttgtcacgtctgctgtgaaatcccgaggctcaacctcgggcctgcagtgggtacgggcagactggagtgcggtaggggagaatggaattcctggtgtagcggtggaatgcgcagatatcaggaggaacaccgatggcgaaggcagttctctgggccgtaactgacgctgaggagcgaaagcgtggggagcgaacagg

SEQ ID NO: 114 - DNA, 254 bp, Unknown
  Kingdom: Bacteria, Phylum: Actinobacteria, Class: Actinobacteria, Order: Micrococcales, Family: Microbacteriaceae, Genus:
atacgtagggtgcaagcgttgtccggaattattgggcgtaaagagctcgtaggcggtttgtcgcgtctgctgtgaaaacccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacagg

SEQ ID NO: 115 - DNA, 254 bp, Unknown
  Kingdom: Bacteria, Phylum: Actinobacteria, Class: Actinobacteria, Order: Micrococcales, Family: Microbacteriaceae, Genus:
atacgtagggtgcaagcgttgtccggaattattgggcgtaaagagctcgtaggcggtctgtcgcgtctgctgtgaaaacccgaggctcaacctcgggcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacagg

SEQ ID NO: 116 - DNA, 254 bp, Unknown
  Kingdom: Bacteria, Phylum: Actinobacteria, Class: Actinobacteria, Order: Micrococcales, Family: Microbacteriaceae, Genus:
atacgtagggtgcgagcgttgtccggaattattgggcgtaaagagctcgtaggcggtctgtcgcgtctgctgtgaaaacccgaggctcaacctcgggcctgcagtgggtacgggcagactagagtgcggtaggggagaatggaattcctggtgtagcggtggaatgcgcagatatcaggaggaacaccgatggcgaaggcagttctctgggccgtaactgacgctgaggagcgaaagcgtggggagcgaacagg

SEQ ID NO: 117 - DNA, 254 bp, Unknown
  Kingdom: Bacteria, Phylum: Actinobacteria, Class: Actinobacteria, Order: Micrococcales, Family: Microbacteriaceae, Genus:
atacgtagggtgcaagcgttgtccggaattattgggcgtaaagagctcgtaggcggtttgtcgcgtctgctgtgaaaacccgaggctcaacctcgggcctgcagtgggtacgggcagactagagtgcggtaggggagaatggaattcctggtgtagcggtggaatgcgcagatatcaggaggaacaccgatggcgaaggcagttctctgggccgttactgacgctgaggagcgaaagcgtggggagcgaacagg

SEQ ID NO: 118 - DNA, 254 bp, Unknown
  Kingdom: Bacteria, Phylum: Actinobacteria, Class: Actinobacteria, Order: Micrococcales, Family: Microbacteriaceae, Genus:
atacgtagggtgcaagcgttatccggaattattgggcgtaaagagctcgtaggcggtttgtcgcgtctgctgtgaaaactgggggctcaacccccagcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcatggggagcgaacagg

SEQ ID NO: 119 - DNA, 254 bp, Unknown
  Kingdom: Bacteria, Phylum: Actinobacteria, Class: Actinobacteria, Order: Micrococcales, Family: Microbacteriaceae, Genus:
atacgtagggtccgagcgttgtccggaattattgggcgtaaagagctcgtaggcggtttgtcgcgtctgctgtgaaatcccgaggctcaacctcgggcctgcagtgggtacgggcagactggagtgcggtaggggagaatggaattcctggtgtagcggtggaatgcgcagatatcaggaggaacaccgatggcgaaggcagttctctgggccgtaactgacgctgaggagcgaaagcgtggggagcgaacagg

SEQ ID NO: 120 - DNA, 254 bp, Unknown
  Kingdom: Bacteria, Phylum: Actinobacteria, Class: Actinobacteria, Order: Micrococcales, Family: Microbacteriaceae, Genus:
atacgtagggtgcaagcgttgtccggaattattgggcgtaaagagctcgtaggcggtttgtcgcgtctgctgtgaaaacgcgaggctcaacctcgcgcctgcagtgggtacgggcagactagagtgtggtaggggagattggaattcctggtgtagcggtggaatgcgcagatatcaggaggaacaccgatggcgaaggcagatctctgggccattactgacgctgaggagcgaaagcgtggggagcgaacagg

SEQ ID NO: 121 - DNA, 254 bp, Unknown
  Kingdom: Bacteria, Phylum: Actinobacteria, Class: Actinobacteria, Order: Micrococcales, Family: Microbacteriaceae, Genus:
atacgtagggtgcaagcgttgtccggaattattgggcgtaaagagctcgtaggcggtttgtcgcgtctgctgtgaaatcccgaggctcaacctcgggcttgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacagg

SEQ ID NO: 122 - DNA, 254 bp, Unknown
  Kingdom: Bacteria, Phylum: Actinobacteria, Class: Actinobacteria, Order: Micrococcales, Family: Microbacteriaceae, Genus:
atacgtagggtgcaagcgttgtccggaattattgggcgtaaagagctcgtaggcggtttgtcgcgtctgctgtgaaaacgcgaggctcaacctcgcgcctgcagtgggtacgggcagactagagtgcggtaggggagattggaattcctggtgtagcggtggaatgcgcagatatcaggaggaacaccgatggcgaaggcagatctctgggccgtaactgacgctgaggagcgaaagcgtggggagcgaacagg

SEQ ID NO: 123 - DNA, 254 bp, Unknown
  Kingdom: Bacteria, Phylum: Actinobacteria, Class: Actinobacteria, Order: Micrococcales, Family: Micrococcaceae, Genus:
atacgtagggcgcaagcgttatccggaattattgggcgtaaagagctcgtaggcggtttgtcgcgtctgctgtgaaagaccggggctcaaccccggttctgcagtgggtacgggcagactagagtgatgtaggggagactggaattcctggtgtagcggtgaaatgcgcagatatcaggaggaacaccgatggcgaaggcaggtctctgggcattaactgacgctgaggagcgaaagcatggggagcgaacagg

SEQ ID NO: 124 - DNA, 254 bp, Unknown
  Kingdom: Bacteria, Phylum: Actinobacteria, Class: Actinobacteria, Order: Micrococcales, Family: Micrococcaceae, Genus:
atacgtagggcgcaagcgttatccggaattattgggcgtaaagagctcgtaggcggtttgtcgcgtctgccgtgaaagtccggggctcaactccggatctgcggtgggtacgggcagactagagtgatgtaggggagactggaattcctggtgtagcggtgaaatgcgcagatatcaggaggaacaccggtggcgaaggcaggtctctgggcattaactgacgctgaggagcgaaagcatggggagcgaacagg

SEQ ID NO: 125 - DNA, 254 bp, Unknown
  Kingdom: Bacteria, Phylum: Actinobacteria, Class: Actinobacteria, Order: Micrococcales, Family: Micrococcaceae, Genus:
atacgtagggcgcaagcgttatccggaattattgggcgtaaagagctcgtaggcggtttgtcgcgtctgctgtgaaagaccggggctcaactccggttctgcagtgggtacgggcagactagagtgatgtaggggagactggaattcctggtgtagcggtgaaatgcgcagatatcaggaggaacaccgatggcgaaggcaggtctctgggcattaactgacgctgaggagcgaaagcatggggagcgaacagg

SEQ ID NO: 126 - DNA, 254 bp, Unknown
  Kingdom: Bacteria, Phylum: Actinobacteria, Class: Actinobacteria, Order: Micrococcales, Family: Micrococcaceae, Genus:
atacgtagggaccgagcgttgtccggattcattgggcgtaaagagctcgtaggcggccactcaagtcgaatgtgaaatctcgaggctcaacctcgagcctgcattcgatactgggcggctagagtctggtagggggatctggaattcctggtgtagcggtggaatgcgcagatatcaggaggaacaccggtggcgaaggcgggatcctgggccagtactgacgctgaggagcgaaagcgtggggagcaaacagg

SEQ ID NO: 127 - DNA, 254 bp, Unknown
  Kingdom: Bacteria, Phylum: Actinobacteria, Class: Actinobacteria, Order: Micrococcales, Family: Micrococcaceae, Genus:
atacgtagggcgcaagcgttatccggaattattgggcgtaaagagctcgtaggcggtttgtcgcgtctgccgtgaaagtccggggctcaactccggatctgcggtgggtacgggcaggctagagtgatgtaggggagactggaattcctggtgtagcggtgaaatgcgcagatatcaggaggaacaccgatggcgaaggcaggtctctgggcattaactgacgctgaggagcgaaagcatggggagcgaacagg

SEQ ID NO: 128 - DNA, 254 bp, Unknown
  Kingdom: Bacteria, Phylum: Actinobacteria, Class: Actinobacteria, Order: Micrococcales, Family: Micrococcaceae, Genus:
atacgtagggcgcaagcgttatccggatttattgggcgtaaagagctcgtaggcggtttgtcgcgtctgccgtgaaagtccgaggctcaacctcggatctgcggtgggtacgggcagactagagtgatgtaggggagactggaattcctggtgtagcggtgaaatgcgcagatatcaggaggaacaccgatggcgaaggcaggtctctgggcatttactgacgctgaggagcgaaagcatggggagcgaacagg

SEQ ID NO: 129 - DNA, 254 bp, Unknown
  Kingdom: Bacteria, Phylum: Actinobacteria, Class: Actinobacteria, Order: Micrococcales, Family: Micrococcaceae, Genus:
atacgtagggcgcaagcgttatccggaattattgggcgtaaagagctcgtaggcggtttgtcgcgtctgctgtgaaagcccggggctcaaccccgggtctgcagtgggtacgggcagactagagtgcagtaggggagactggaattcctggtgtagcggtgaaatgcgcagatatcaggaggaacaccgatggcgaaggcaggtctctgggctgtaactgacgctgaggagcgaaagcatggggagcgaacagg

SEQ ID NO: 130 - DNA, 254 bp, Unknown
  Kingdom: Bacteria, Phylum: Actinobacteria, Class: Actinobacteria, Order: Micrococcales, Family: Micrococcaceae, Genus:
atacgtagggcgcaagcgttatccggaattattgggcgtaaagagctcgtaggcggtttgtcgcgtctgccgtgaaagtccggggctcaaccccggatctgcggtgggtacgggcagactagagtgatgtaggggagactggaattcctggtgtagcggtgaaatgcgcagatatcaggaggaacaccgatggcgaaggcaggtctctgggcattaactgacgctgaggagcgaaagcatggggagcgaacagg

SEQ ID NO: 131 - DNA, 254 bp, Unknown
  Kingdom: Bacteria, Phylum: Actinobacteria, Class: Actinobacteria, Order: Micrococcales, Family: Micrococcaceae, Genus:
atacgtagggcgcaagcgttatccggaattattgggcgtaaagagctcgtaggcggtttgtcgcgtctgctgtgaaagaccggggctcaactccggttctgcagtgggtacgggcagactagagtgcagtaggggagactggaattcctggtgtagcggtgaaatgcgcagatatcaggaggaacaccgatggcgaaggcaggtctctgggctgtaactgacgctgaggagcgaaagcatggggagcgaacagg

SEQ ID NO: 132 - DNA, 254 bp, Unknown
  Kingdom: Bacteria, Phylum: Actinobacteria, Class: Actinobacteria, Order: Micrococcales, Family: Micrococcaceae, Genus:
atacgtagggcgcaagcgttatccggaattattgggcgtaaagagctcgtaggcggtttgtcgcgtctgccgtgaaagcccggggctcaactccggatctgcggtgggtacgggcagactagagtgatgtaggggagactggaattcctggtgtagcggtgaaatgcgcagatatcaggaggaacaccgatggcgaaggcaggtctctgggcattaactgacgctgaggagcgaaagcatggggagcgaacagg

SEQ ID NO: 133 - DNA, 254 bp, Unknown
  Kingdom: Bacteria, Phylum: Actinobacteria, Class: Actinobacteria, Order: Micrococcales, Family: Micrococcaceae, Genus:
atacgtagggcgcaagcgttatccggatttattgggcgtaaagagctcgtaggcggtttgtcgcgtctatcgtgaaagtccgaggctcaacctcggatctgcggtgggtacgggcagactagagtgatgtaggggagactggaattcctggtgtagcggtgaaatgcgcagatatcaggaggaacaccgatggcgaaggcaggtctctgggcatttactgacgctgaggagcgaaagcatggggagcgaacagg

SEQ ID NO: 134 - DNA, 254 bp, Unknown
  Kingdom: Bacteria, Phylum: Actinobacteria, Class: Actinobacteria, Order: Micrococcales, Family: Micrococcaceae, Genus:
atacgtagggcgcaagcgttatccggaattattgggcgtaaagagctcgtaggcggtttgtcgcgtctgccgtgagagtccggggctcaactccggatctgcggtgggtacgggcagactagagtgatgtaggggagactggaattcctggtgtagcggtgaaatgcgcagatatcaggaggaacaccgatggcgaaggcaggtctctgggcattaactgacgctgaggagcgaaagcatggggagcgaacagg

SEQ ID NO: 135 - DNA, 255 bp, Unknown
  Kingdom: Bacteria, Phylum: Actinobacteria, Class: Actinobacteria, Order: Micrococcales, Family: Micrococcaceae, Genus:
atacgtagggcgcgagcgttgtccggaattattgggcgtaaagagcttgtaggcggtttgtcgcgtctgctgtgaaaggccggagcttaactccgtgtattgcagtgggtacgggcagactagagtgcagtaggggagactggaattcctggtgtagcggtggaatgcgcagatatcaggaggaacaccgatggcgaaggcaggtctctgggctgtaactgacgctgagaagcgaaagcatggggagcgaacagg

SEQ ID NO: 136 - DNA, 254 bp, Unknown
  Kingdom: Bacteria, Phylum: Actinobacteria, Class: Actinobacteria, Order: Micrococcales, Family: Micrococcaceae, Genus:
atacgtagggtgcgagcgttatccggaattattgggcgtaaagagctcgtaggcggtttgtcgcgtctgtcgtgaaagtccggggcttaaccccggatctgcggtgggtacgggcagactagagtgcagtaggggagactggaattcctggtgtagcggtggaatgcgcagatatcaggaggaacaccgatggcgaaggcaggtctctgggctgtaactgacgctgaggagcgaaagcatggggagcgaacagg

SEQ ID NO: 137 - DNA, 254 bp, Unknown
  Kingdom: Bacteria, Phylum: Actinobacteria, Class: Actinobacteria, Order: Micrococcales, Family: Micrococcaceae, Genus:
atacgtagggcgcaagcgttatccggaattattgggcgtaaagagctcgtaggcggtttgtcgcgtctgccgtgaaagtccggggctcaactccggatctgcggtgggtacgggcagactagagtgatgtaggggagactggaattcctggtgtagcggtgaaatgcgcagatatcaggaggaacaccgatggcgaaggcaggtctctgggcattaactgacgctgaggagcgaaagcatggggagcgaacagg

SEQ ID NO: 138 - DNA, 254 bp, Unknown
  Kingdom: Bacteria, Phylum: Actinobacteria, Class: Actinobacteria, Order: Micrococcales, Family: Promicromonosporaceae, Genus:
atacgtagggcgcaagcgttgtccggaattattgggcgtaaagagctcgtaggcggtctgtcgcgtctggtgtgaaatcccatggctcaactgtgggcttgcatcgggtacgggcagactagagtgctgtaggggagactggaattcctggtgtagcggtggaatgcgcagatatcaggaggaacaccgatggcgaaggcaggtctctgggcagttactgacgctgaggagcgaaagcatggggagcgaacagg

SEQ ID NO: 139 - DNA, 254 bp, Unknown
  Kingdom: Bacteria, Phylum: Actinobacteria, Class: Actinobacteria, Order: Micrococcales, Family: Promicromonosporaceae, Genus:
atacgtagggcgcaagcgttgtccggaattattgggcgtaaagagctcgtaggcggtttgtcgcgtctggtgtgaaaactcgaggctcaacctcgagcttgcatcgggtacgggcagactagagtgcggtaggggagactggaattcctggtgtagcggtggaatgcgcagatatcaggaggaacaccgatggcgaaggcaggtctctgggccgcaactgacgctgaggagcgaaagcatggggagcgaacagg

SEQ ID NO: 140 - DNA, 254 bp, Unknown
  Kingdom: Bacteria, Phylum: Actinobacteria, Class: Actinobacteria, Order: Micrococcales, Family: Promicromonosporaceae, Genus:
atacgtagggcgcaagcgttgtccggaattattgggcgtaaagagctcgtaggcggtctgtcgcgtctggtgtgaaatcccatggctcaactgtgggcttgcatcgggtacgggcagactagagtgctgtaggggagactggaattcctggtgtagcggtggaacgcgcagatatcaggaggaacaccgatggcgaaggcaggtctctgggcagttactgacgctgaggagcgaaagcatggggagcgaacagg

SEQ ID NO: 141 - DNA, 254 bp, Unknown
  Kingdom: Bacteria, Phylum: Actinobacteria, Class: Actinobacteria, Order: Micrococcales, Family: Sanguibacteraceae, Genus:
atacgtagggcgcaagcgttgtccggaattattgggcgtaaagagctcgtaggcggtttgtcgcgtctggtgtgaaaactcaaggctcaaccttgagcttgcatcgggtacgggcagactagagtgtggtaggggtgactggaattcctggtgtagcggtggaatgcgcagatatcaggaggaacaccgatggcgaaggcaggtcactgggccactactgacgctgaggagcgaaagcatggggagcgaacagg

SEQ ID NO: 142 - DNA, 254 bp, Unknown
  Kingdom: Bacteria, Phylum: Actinobacteria, Class: Actinobacteria, Order: Micromonosporales, Family: Micromonosporaceae, Genus:
agacgtagggcgcgagcgttgtccggatttattgggcgtaaagagctcgtaggcggcttgtcgcgtcgactgtgaaaacccgcggctcaactgcgggcctgcagtcgatacgggcaggctagagttcggtaggggagactggaattcctggtgtagcggtgaaatgcgcagatatcaggaggaacaccggtggcgaaggcgggtctctgggccgatactgacgctgaggagcgaaagcgtggggagcgaacagg

SEQ ID NO: 143 - DNA, 254 bp, Unknown
  Kingdom: Bacteria, Phylum: Actinobacteria, Class: Actinobacteria, Order: Micromonosporales, Family: Micromonosporaceae, Genus:
agacgtagggcgcgagcgttgtccggatttattgggcgtaaagagctcgtaggcggcttgtcgcgtcgaatgtgaaatctcagagctcaactctgacattgcattcgatacgggcaggctagagttcggtaggggagactggaattcctggtgtagcggtgaaatgcgcagatatcaggaggaacaccgatggcgaaggcaggtctctgggccgatactgacgctgaggagcgaaagcgtggggagcgaacagg

SEQ ID NO: 144 - DNA, 254 bp, Unknown
  Kingdom: Bacteria, Phylum: Actinobacteria, Class: Actinobacteria, Order: Micromonosporales, Family: Micromonosporaceae, Genus:
agacgtagggcgcgagcgttgtccggatttattgggcgtaaagagctcgtaggcggcttgtcgcgtcggctgtgaaatcccgtggctcaactgcgggcttgcagccgatacgggcaggctagagttcggtaggggagactggaattcctggtgtagcggtgaaatgcgcagatatcaggaggaacaccggtggcgaaggcgggtctctgggccgatactgacgctgaggagcgaaagcgtggggagcgaacagg

SEQ ID NO: 145 - DNA, 254 bp, Unknown
  Kingdom: Bacteria, Phylum: Actinobacteria, Class: Actinobacteria, Order: Micromonosporales, Family: Micromonosporaceae, Genus:
agacgtagggcgcgagcgttgtccggatttattgggcgtaaagagctcgtaggcggcttgtcgcgtcgactgtgaaaacccgcggctcaaccgcgggcctgcagccgatacgggcaggctagagttcggtaggggagactggaattcctggtgtagcggtgaaatgcgcagatatcaggaggaacaccgatggcgaaggcaggtctctgggccgatactgacgctgaggagcgaaagcgtggggagcgaacagg

SEQ ID NO: 146 - DNA, 254 bp, Unknown
  Kingdom: Bacteria, Phylum: Actinobacteria, Class: Actinobacteria, Order: Micromonosporales, Family: Micromonosporaceae, Genus:
agacgtagggtgcgagcgttgtccggatttattgggcgtaaagagctcgtaggcggctcgtcgcgtcgaccgtgaaaacccgcagcttaactgcgggcttgcggttgatacgggcgggctagagttcggtaggggagactggaattcctggtgtagcggtgaaatgcgcagatatcaggaggaacaccggtggcgaaggcgggtctctgggccgatactgacgctgaggagcgaaagcgtggggagcgaacagg

SEQ ID NO: 147 - DNA, 255 bp, Unknown
  Kingdom: Bacteria, Phylum: Actinobacteria, Class: Actinobacteria, Order: Micromonosporales, Family: Micromonosporaceae, Genus:
agacgtagggcgcgagcgttgtccggatttattgggcgtaaagagctcgtaggcggcttgtcgcgtcgaccgtgaaaactcgcagctcaactgcgagcctgcggtcgatacgggcaggctagagttcggtaggggagactggaattcctggtgtagcggtgaaatgcgcagatatcaggaggaacaccgatggcgaaggcaggtctctgggccgatactgacgctgaggagcgaaagcgtgggggagcgaacagg

SEQ ID NO: 148 - DNA, 254 bp, Unknown
  Kingdom: Bacteria, Phylum: Actinobacteria, Class: Actinobacteria, Order: Micromonosporales, Family: Micromonosporaceae, Genus:
agacgtagggcgcgagcgttgtccggatttattgggcgtaaagagctcgtaggcggcttgtcgcgtcgactgtgaaaacccgcggctcaactgcgggcctgcagccgatacgggcaggctagagttcggtaggggagactggaattcctggtgtagcggtgaaatgcgcagatatcaggaggaacaccggtggcgaaggcgggtctctgggccgatactgacgctgaggagcgaaagcgtggggagcgaacagg

SEQ ID NO: 149 - DNA, 254 bp, Unknown
  Kingdom: Bacteria, Phylum: Actinobacteria, Class: Actinobacteria, Order: Propionibacteriales, Family: Nocardioidaceae, Genus: Kribbella
atacgtagggtccgagcgttgtccggaattattgggcgtaaagggctcgtaggcggttcgtcgcgtcgggagtgaaaactcggagcttaactccgagcctgcttccgatacgggcagactagaggtaggcaggggagagcggaactcctggtgtagcggtggaatgcgcagatatcaggaagaacaccggtggcgaaggcggctctctgggccttacctgacgctgaggagcgaaagcgtgggtagcgaacagg

SEQ ID NO: 150 - DNA, 254 bp, Unknown
  Kingdom: Bacteria, Phylum: Actinobacteria, Class: Actinobacteria, Order: Propionibacteriales, Family: Nocardioidaceae, Genus: Nocardioides
atacgtagggtgcgagcgttgtccggaattattgggcgtaaagggctcgtaggcggtttgtcgcgtcgggagtgaaaaccaggtgcttaacacctggcttgctttcgatacgggcagactagaggtattcaggggagaacggaattcctggtgtagcggtgaaatgcgcagatatcaggaggaacaccggtggcgaaggcggttctctgggaatgacctgacgctgaggagcgaaagtgtggggagcgaacagg

SEQ ID NO: 151 - DNA, 254 bp, Unknown
  Kingdom: Bacteria, Phylum: Actinobacteria, Class: Actinobacteria, Order: Propionibacteriales, Family: Nocardioidaceae, Genus:
atacgtagggtgcgagcgttgtccggaattattgggcgtaaagggctcgtaggcggtttgtcgcgtcgggagtgaaaacgccgtgcttaacacggcgcttgctttcgatacgggcagactagaggtattcaggggagaacggaattcctggtgtagcggtgaaatgcgcagatatcaggaggaacaccggtggcgaaggcggttctctgggaatgacctgacgctgaggagcgaaagtgtggggagcgaacagg

SEQ ID NO: 152 - DNA, 254 bp, Unknown
  Kingdom: Bacteria, Phylum: Actinobacteria, Class: Actinobacteria, Order: Propionibacteriales, Family: Nocardioidaceae, Genus:
atacgtagggtgcgagcgttgtccggaattattgggcgtaaagggctcgtaggcggtttgtcgcgtcgggagtgaaaactcagggcttaaccctgagcctgcttccgatacgggcagactagaggtatgcaggggagaacggaattcctggtgtagcggtgaaatgcgcagatatcaggaggaacaccggtggcgaaggcggttctctgggcattacctgacgctgaggagcgaaagtgtggggagcgaacagg

SEQ ID NO: 153 - DNA, 254 bp, Unknown
  Kingdom: Bacteria, Phylum: Actinobacteria, Class: Actinobacteria, Order: Propionibacteriales, Family: Nocardioidaceae, Genus:
atacgtagggtccgagcgttgtccggaattattgggcgtaaagggctcgtaggcggttagtcacgtcgggagtgaaaactcagggctcaaccctgagcgtgcttccgatacgggctgactagaggtatgcaggggagaacggaattcctggtgtagcggtggaatgcgcagatatcaggaggaacaccggtggcgaaggcggttctctgggcattacctgacgctgaggagcgaaagcatggggagcgaacagg

SEQ ID NO: 154 - DNA, 254 bp, Unknown
  Kingdom: Bacteria, Phylum: Actinobacteria, Class: Actinobacteria, Order: Propionibacteriales, Family: Nocardioidaceae, Genus:
atacgtagggtccgagcgttgtccggaattattgggcgtaaagggctcgtaggcggttcgtcacgtcgggagtgaaaactcggggcttaaccccgagcctgcttccgatacgggcagactagaggtaggcaggggagagcggaactcctggtgtagcggtggaatgcgcagatatcaggaagaacaccggtggcgaaggcggctctctgggccttacctgacgctgaggagcgaaagcgtgggtagcgaacagg

SEQ ID NO: 155 - DNA, 254 bp, Unknown
  Kingdom: Bacteria, Phylum: Actinobacteria, Class: Actinobacteria, Order: Propionibacteriales, Family: Nocardioidaceae, Genus:
atacgtagggtgcgagcgttgtccggaattattgggcgtaaagggctcgtaggcggtttgtcgcgtcgggagtgaaaacgccgtgcttaacacggcgcttgctttcgatacgggcagactagaggtatgcaggggagaacggaattcctggtgtagcggtgaaatgcgcagatatcaggaggaacaccggtggcgaaggcggttctctgggcattacctgacgctgaggagcgaaagtgtggggagcgaacagg

SEQ ID NO: 156 - DNA, 254 bp, Unknown
  Kingdom: Bacteria, Phylum: Actinobacteria, Class: Actinobacteria, Order: Propionibacteriales, Family: Nocardioidaceae, Genus:
atacgtagggtgcgagcgttgtccggaattattgggcgtaaagggctcgtaggcggtttgttacgtcgggagtgaaaactcggggctcaaccccgagcctgcttccgatacgggcagactagaggtatgcaggggagaacggaattcctggtgtagcggtgaaatgcgcagatatcaggaggaacaccggtggcgaaggcggttctctgggcattacctgacgctgaggagcgaaagtgtggggagcgaacagg

SEQ ID NO: 157 - DNA, 254 bp, Unknown
  Kingdom: Bacteria, Phylum: Actinobacteria, Class: Actinobacteria, Order: Propionibacteriales, Family: Nocardioidaceae, Genus:
atacgtagggtgcgagcgttgtccggaattattgggcgtaaagggctcgtaggcggtttgtcgcgtcgggagtgaaaacatccagcttaactgggtgcttgctttcgatacgggcagacttgaggtatgcaggggagaatggaattcctggtgtagcggtgaaatgcgcagatatcaggaggaacaccggtggcgaaggcggttctctgggcattacctgacgctgaggagcgaaagtgtggggagcgaacagg

SEQ ID NO: 158 - DNA, 254 bp, Unknown
  Kingdom: Bacteria, Phylum: Actinobacteria, Class: Actinobacteria, Order: Propionibacteriales, Family: Nocardioidaceae, Genus:
atacgtagggtgcgagcgttgtccggaattattgggcgtaaagggctcgtaggcggtctgttgcgtcgggagtgaaaactcagggcttaaccctgagcctgcttccgatacgggcagactagaggtatgcaggggagaacggaattcctggtgtagcggtgaaatgcgcagatatcaggaggaacaccggtggcgaaggcggttctctgggcattacctgacgctgaggagcgaaagtgtggggagcgaacagg

SEQ ID NO: 159 - DNA, 254 bp, Unknown
  Kingdom: Bacteria, Phylum: Actinobacteria, Class: Actinobacteria, Order: Propionibacteriales, Family: Nocardioidaceae, Genus:
atacgtagggtccgagcgttgtccggaattattgggcgtaaagggctcgtaggcggtttgtcgcgtcgggagtgaaaactcagggctcaaccctgagcgtgcttccgatacgggcagactagaggtatgcaggggagaacggaattcctggtgtagcggtggaatgcgcagatatcaggaggaacaccggtggcgaaggcggttctctgggcattacctgacgctgaggagcgaaagcatggggagcgaacagg

SEQ ID NO: 160 - DNA, 254 bp, Unknown
  Kingdom: Bacteria, Phylum: Actinobacteria, Class: Actinobacteria, Order: Propionibacteriales, Family: Nocardioidaceae, Genus:
atacgtagggtccgagcgttgtccggaattattgggcgtaaagggctcgtaggcggttcgtcacgtcgggagtgaaaactcggagcttaactccgagcctgcttccgatacgggcagactagaggtaggcaggggagagcggaactcctggtgtagcggtggaatgcgcagatatcaggaagaacaccggtggcgaaggcggctctctgggccttacctgacgctgaggagcgaaagcgtgggtagcgaacagg

SEQ ID NO: 161 - DNA, 254 bp, Unknown
  Kingdom: Bacteria, Phylum: Actinobacteria, Class: Actinobacteria, Order: Propionibacteriales, Family: Nocardioidaceae, Genus:
atacgtagggtgcgagcgttgtccggaattattgggcgtaaagggctcgtaggcggtttgtcacgtcgggagtgaaaactcagggcttaaccctgagcctgcttccgatacgggcagactagaggtatgcaggggagaacggaattcctggtgtagcggtgaaatgcgcagatatcaggaggaacaccggtggcgaaggcggttctctgggcattacctgacgctgaggagcgaaagtgtggggagcgaacagg

SEQ ID NO: 162 - DNA, 254 bp, Unknown
  Kingdom: Bacteria, Phylum: Actinobacteria, Class: Actinobacteria, Order: Propionibacteriales, Family: Nocardioidaceae, Genus:
atacgtagggtgcgagcgttgtccggaattattgggcgtaaagggctcgtaggcggtttgtcgcgtcgggagtgaaaaccaggtgcttaacacctggcttgctttcgatacgggcagactagaggtatgcaggggagaacggaattcctggtgtagcggtgaaatgcgcagatatcaggaggaacaccggtggcgaaggcggttctctgggcatgacctgacgctgaggagcgaaagtgtggggagcgaacagg

SEQ ID NO: 163 - DNA, 254 bp, Unknown
  Kingdom: Bacteria, Phylum: Actinobacteria, Class: Actinobacteria, Order: Propionibacteriales, Family: Nocardioidaceae, Genus:
atacgtagggtgcgagcgttgtccggaattattgggcgtaaagggctcgtaggcggtttgtcgcgtcgggagtgaaaacactgggcttaaccgagtgcttgctttcgatacgggcagacttgaggcattgaggggagaacggaattcctggtgtagcggtgaaatgcgcagatatcaggaggaacaccggtggcgaaggcggttctctggcaatgttctgacgctgaggagcgaaagtgtggggagcgaacagg

SEQ ID NO: 164 - DNA, 254 bp, Unknown
  Kingdom: Bacteria, Phylum: Actinobacteria, Class: Actinobacteria, Order: Propionibacteriales, Family: Nocardioidaceae, Genus:
atacgtagggtccgagcgttgtccggaattattgggcgtaaagggctcgtaggcggttcgtcacgtcgggagtgaaaactcggagctcaactccgagcctgcttccgatacgggcagactagaggtaggcaggggagagcggaactcctggtgtagcggtggaatgcgcagatatcaggaagaacaccggtggcgaaggcggctctctgggccttacctgacgctgaggagcgaaagcgtgggtagcgaacagg

SEQ ID NO: 165 - DNA, 254 bp, Unknown
  Kingdom: Bacteria, Phylum: Actinobacteria, Class: Actinobacteria, Order: Propionibacteriales, Family: Nocardioidaceae, Genus:
atacgtagggtccgagcgttgtccggaattattgggcgtaaagggctcgtaggcggtctgtcgcgtcgggagtgaaaaccaggtgcttaacacctggcctgcttccgatacgggcagactagaggtactcaggggagaatggaattcctggtgtagcggtgaaatgcgcagatatcaggaggaacaccggtggcgaaggcggttctctgggagtatcctgacgctgaggagcgaaagtgtggggagcgaacagg

SEQ ID NO: 166 - DNA, 254 bp, Unknown
  Kingdom: Bacteria, Phylum: Actinobacteria, Class: Actinobacteria, Order: Propionibacteriales, Family: Nocardioidaceae, Genus:
atacgtagggtccgagcgttgtccggaattattgggcgtaaagggctcgtaggcggtttgtcacgtcgggcgtgaaaactcagggctcaaccctgagcgtgcgtccgatacgggcagactagaggtatgcaggggagaacggaattcctggtgtagcggtggaatgcgcagatatcaggaggaacaccggtggcgaaggcggttctctgggcattacctgacgctgaggagcgaaagcatggggagcgaacagg

SEQ ID NO: 167 - DNA, 254 bp, Unknown
  Kingdom: Bacteria, Phylum: Actinobacteria, Class: Actinobacteria, Order: Pseudonocardiales, Family: Pseudonocardiaceae, Genus: Saccharopolyspora
atacgtagggtgcgagcgttgtccggaattattgggcgtaaagagctcgtaggcggtttgtcgcgtcggccgtgaaaacctgccgcttaacggtgggcgtgcggtcgatacgggcagacttgagttcggtaggggagactggaattcctggtgtagcggtgaaatgcgcagatatcaggaggaacaccggtggcgaaggcgggtctctgggccgatactgacgctgaggagcgaaagcgtggggagcgaacagg

SEQ ID NO: 168 - DNA, 255 bp, Unknown
  Kingdom: Bacteria, Phylum: Actinobacteria, Class: Actinobacteria, Order: Pseudonocardiales, Family: Pseudonocardiaceae, Genus:
atacgtagggtgcgagcgttgtccggaattattgggcgtaaagagctcgtaggcggtgtgtcacgtcgatcgtgaaaacttggggcttaaccctgagcgtgcggtcgatacgggcatcacttgagttcggcaggggagactggaattcctggtgtagcggtgaaatgcgcagatatcaggaggaacaccggtggcgaaggcgggtctctgggccgatactgacgctgaggagcgaaagcgtggggagcgaacagg

SEQ ID NO: 169 - DNA, 255 bp, Unknown
  Kingdom: Bacteria, Phylum: Actinobacteria, Class: Actinobacteria, Order: Pseudonocardiales, Family: Pseudonocardiaceae, Genus:
acacgtagggtgcgagcgttgtccggaattattgggcgtaaagagctcgtaggcggtgtgtcgcgtcggccgtgaaaacctgcagcttaactgtgggcttgcggtcgatacgggcatcactggagttcggcaggggagactggaattcctggtgtagcggtgaaatgcgcagatatcaggaggaacaccggtggcgaaggcgggtctctgggccgatactgacgctgaggagcgaaagcgtggggagcgaacagg

SEQ ID NO: 170 - DNA, 254 bp, Unknown
  Kingdom: Bacteria, Phylum: Actinobacteria, Class: Actinobacteria, Order: Pseudonocardiales, Family: Pseudonocardiaceae, Genus:
atacgtagggtgcgagcgttgtccggaattattgggcgtaaagagctcgtaggcggtttgtcgcgtcggccgtgaaaacttggggcttaactccaagcttgcggtcgatacgggcagacttgagttcggcaggggagactggaattcctggtgtagcggtgaaatgcgcagatatcaggaggaacaccggtggcgaaggcgggtctctgggccgatactgacgctgaggagcgaaagcgtggggagcgaacagg

SEQ ID NO: 171 - DNA, 255 bp, Unknown
  Kingdom: Bacteria, Phylum: Actinobacteria, Class: Actinobacteria, Order: Pseudonocardiales, Family: Pseudonocardiaceae, Genus:
atacgtagggtgcgagcgttgtccggaattattgggcgtaaagagctcgtaggcggtgtgtcgcgtcggccgtgaaaacctggggctcaactctgggcgtgcggtcgatacgggcatcacttgagttcggcaggggagactggaattcctggtgtagcggtgaaatgcgcagatatcaggaggaacaccggtggcgaaggcgggtctctgggccgatactgacgctgaggagcgaaagcatgggtagcgaacagg

SEQ ID NO: 172 - DNA, 253 bp, Unknown
  Kingdom: Bacteria, Phylum: Actinobacteria, Class: Actinobacteria, Order: Pseudonocardiales, Family: Pseudonocardiaceae, Genus:
tacgtagggtgcaagcgttgtccggaattattgggcgtaaagagctcgtaggcggtttgtcgcgtcggctgtgaaaacttggggcttaactccgagcgtgcagtcgatacgggcagacttgagtatggcaggggagactggaattcctggtgtagcggtgaaatgcgcagatatcaggaggaacaccggtggcgaaggcgggtctctgggccattactgacgctgaggagcgaaagcatggggagcgaacagg

SEQ ID NO: 173 - DNA, 254 bp, Unknown
  Kingdom: Bacteria, Phylum: Actinobacteria, Class: Actinobacteria, Order: Pseudonocardiales, Family: Pseudonocardiaceae, Genus:
atacgtagggtgcgagcgttgtccggatttattgggcgtaaagagctcgtaggcggtttgttgcgtcggctgtgaaaacctacagcttaactgtgggcctgcagtcgatacgggcagacttgagttcggcaggggagactggaattcctggtgtagcggtgaaatgcgcagatatcaggaggaacaccggtggcgaaggcgggtctctgggccgatactgacgctgaggagcgaaagcgtggggagcgaacagg

SEQ ID NO: 174 - DNA, 254 bp, Unknown
  Kingdom: Bacteria, Phylum: Actinobacteria, Class: Actinobacteria, Order: Pseudonocardiales, Family: Pseudonocardiaceae, Genus:
atacgtagggtgcgagcgttgtccggaattattgggcgtaaagagctcgtaggcggtttgtcgcgtcggccgtgaaaacttggggcttaaccccgagcctgcggtcgatacgggcagacttgagttcggcaggggagactggaattcctggtgtagcggtgaaatgcgcagatatcaggaggaacaccggtggcgaaggcgggtctctgggccgatactgacgctgaggagcgaaagcgtggggagcgaacagg

SEQ ID NO: 175 - DNA, 254 bp, Unknown
  Kingdom: Bacteria, Phylum: Actinobacteria, Class: Actinobacteria, Order: Pseudonocardiales, Family: Pseudonocardiaceae, Genus:
atacgtagggtgcgagcgttgtccggaattattgggcgtaaagagctcgtaggcggtttgtcgcgtcgttcgtgaaaactccacgcttaacgtggagcgtgcgggcgatacgggcagacttgagttcggtaggggagactggaattcctggtgtagcggtgaaatgcgcagatatcaggaggaacaccggtggcgaaggcgggtctctgggccgatactgacgctgaggagcgaaagcgtggggagcgaacagg

SEQ ID NO: 176 - DNA, 254 bp, Unknown
  Kingdom: Bacteria, Phylum: Actinobacteria, Class: Actinobacteria, Order: Pseudonocardiales, Family: Pseudonocardiaceae, Genus:
atacgtagggtgcgagcgttgtccggaattattgggcgtaaagagctcgtaggcggtttgtcgcgtcggccgtgaaaacttggggcttaactccaagcttgcggtcgatacgggcagacttgagttcggcaggggagactggaattcctggtgtagcggtgaaatgcgcagatatcaggaggaacaccggtggcgaaggcgggtctctgggccgacactgacgctgaggagcgaaagcgtggggagcgaacagg

SEQ ID NO: 177 - DNA, 254 bp, Unknown
  Kingdom: Bacteria, Phylum: Actinobacteria, Class: Actinobacteria, Order: Pseudonocardiales, Family: Pseudonocardiaceae, Genus:
atacgtagggtgcgagcgttgtccggatttattgggcgtaaagagctcgtaggcggtttgtcgcgtcggccgtgaaatctccacgcttaacgtggagcgtgcggtcgatacgggcagacttgagttcggtaggggagactggaattcctggtgtagcggtgaaatgcgcagatatcaggaggaacaccggtggcgaaggcgggtctctgggccgatactgacgctgaggagcgaaagcgtggggagcgaacagg

SEQ ID NO: 178 - DNA, 254 bp, Unknown
  Kingdom: Bacteria, Phylum: Actinobacteria, Class: Actinobacteria, Order: Streptomycetales, Family: Streptomycetaceae, Genus:
atacgtagggcgcaagcgttgtccggaattattgggcgtaaagagctcgtaggcggcttgtcgcgtcggttgtgaaagcccggggcttaaccccgggtctgcagtcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacagg

SEQ ID NO: 179 - DNA, 254 bp, Unknown
  Kingdom: Bacteria, Phylum: Actinobacteria, Class: Actinobacteria, Order: Streptomycetales, Family: Streptomycetaceae, Genus:
atacgtagggcgcaagcgttgtccggaattattgggcgtaaagagctcgtaggcggccagtcgcgtcgggtgtgaaagaccggggcttaaccccggttctgcattcgatacgggctggctagagtgtggtaggggagatcggaattcctggtgtagcggtgaaatgcgcagatatcaggaggaacaccggtggcgaaggcggatctctgggccattactgacgctgaggagcgaaagcgtggggagcgaacagg

SEQ ID NO: 180 - DNA, 254 bp, Unknown
  Kingdom: Bacteria, Phylum: Actinobacteria, Class: Actinobacteria, Order: Streptomycetales, Family: Streptomycetaceae, Genus:
atacgtagggtgcgagcgttgtccggaattattgggcgtaaagagctcgtaggcggtctgtcacgtcggatgtgaaagcccggggcttaaccccgggtctgcattcgatacgggcagactagagtgtggtaggggagatcggaattcctggtgtagcggtgaaatgcgcagatatcaggaggaacaccggtggcgaaggcggatctctgggccattactgacgctgaggagcgaaagcgtggggagcgaacagg

SEQ ID NO: 181 - DNA, 254 bp, Unknown
  Kingdom: Bacteria, Phylum: Actinobacteria, Class: Actinobacteria, Order: Streptomycetales, Family: Streptomycetaceae, Genus:
atacgtagggcgcaagcgttgtccggaattattgggcgtaaagagctcgtaggcggtctgtcgcgtcggatgtgaaagcccggggcttaaccccgggtctgcattcgatacgggcagactagagtgtggtaggggagatcggaattcctggtgtagcggtgaaatgcgcagatatcaggaggaacaccggtggcgaaggcggatctctgggccattactgacgctgaggagcgaaagcgtggggagcgaacagg

SEQ ID NO: 182 - DNA, 254 bp, Unknown
  Kingdom: Bacteria, Phylum: Actinobacteria, Class: Actinobacteria, Order: Streptomycetales, Family: Streptomycetaceae, Genus:
atacgtagggtgcgagcgttgtccggaattattgggcgtaaagagctcgtaggcggcctgtcgcgtcggatgtgaaagcccggggcttaaccccgggtctgcattcgatacgggcaggctagagtgtggtaggggagatcggaattcctggtgtagcggtgaaatgcgcagatatcaggaggaacaccggtggcgaaggcggatctctgggccattactgacgctgaggagcgaaagcgtggggagcgaacagg

SEQ ID NO: 183 - DNA, 254 bp, Unknown
  Kingdom: Bacteria, Phylum: Actinobacteria, Class: Actinobacteria, Order: Streptomycetales, Family: Streptomycetaceae, Genus:
atacgtagggtgcgagcgttgtccggaattattgggcgtaaagagctcgtaggcggcttgtcgcgtcggatgtgaaagcccggggcttaactccgggtctgcattcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacagg

SEQ ID NO: 184 - DNA, 254 bp, Unknown
  Kingdom: Bacteria, Phylum: Actinobacteria, Class: Actinobacteria, Order: Streptomycetales, Family: Streptomycetaceae, Genus:
atacgtagggcgcaagcgttgtccggaattattgggcgtaaagagctcgtaggcggcttgtcacgtcggttgtgaaagcccggggcttaaccccgggtctgcagtcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacagg

SEQ ID NO: 185 - DNA, 254 bp, Unknown
  Kingdom: Bacteria, Phylum: Actinobacteria, Class: Actinobacteria, Order: Streptomycetales, Family: Streptomycetaceae, Genus:
atacgtagggcgcaagcgttgtccggaattattgggcgtaaagagctcgtaggcggcttgtcacgtcgggtgtgaaagcccggggcttaaccccgggtctgcattcgatacgggcaggctagagtgtggtaggggagatcggaattcctggtgtagcggtgaaatgcgcagatatcaggaggaacaccggtggcgaaggcggatctctgggccattactgacgctgaggagcgaaagcgtggggagcgaacagg

SEQ ID NO: 186 - DNA, 254 bp, Unknown
  Kingdom: Bacteria, Phylum: Actinobacteria, Class: Actinobacteria, Order: Streptomycetales, Family: Streptomycetaceae, Genus:
atacgtagggtgcgagcgttgtccggaattattgggcgtaaagagctcgtaggcggcttgtcgcgtcggatgtgaaagcccgaggcttaacctcgggtctgcattcgatacgggcaggctagagtgtggtaggggagatcggaattcctggtgtagcggtgaaatgcgcagatatcaggaggaacaccggtggcgaaggcggatctctgggccattactgacgctgaggagcgaaagcgtggggagcgaacagg

SEQ ID NO: 187 - DNA, 254 bp, Unknown
  Kingdom: Bacteria, Phylum: Actinobacteria, Class: Actinobacteria, Order: Streptomycetales, Family: Streptomycetaceae, Genus:
atacgtagggcgcaagcgttgtccggaattattgggcgtaaagagctcgtaggcggcttgtcacgtcgggtgtgaaagcccggggcttaaccccgggtctgcattcgatacgggctagctagagtgtggtaggggagatcggaattcctggtgtagcggtgaaatgcgcagatatcaggaggaacaccggtggcgaaggcggatctctgggccattactgacgctgaggagcgaaagcgtggggagcgaacagg

SEQ ID NO: 188 - DNA, 254 bp, Unknown
  Kingdom: Bacteria, Phylum: Actinobacteria, Class: Actinobacteria, Order: Streptomycetales, Family: Streptomycetaceae, Genus:
atacgtagggcgcgagcgttgtccggaattattgggcgtaaagagctcgtaggcggtctgtcgcgtcggatgtgaaagcccggggcttaaccccgggtctgcattcgatacgggcagactagagtgtggtaggggagatcggaattcctggtgtagcggtgaaatgcgcagatatcaggaggaacaccggtggcgaaggcggatctctgggccattactgacgctgaggagcgaaagcgtggggagcgaacagg

SEQ ID NO: 189 - DNA, 254 bp, Unknown
  Kingdom: Bacteria, Phylum: Actinobacteria, Class: Actinobacteria, Order: Streptomycetales, Family: Streptomycetaceae, Genus:
atacgtagggcgcaagcgttgtccggaattattgggcgtaaagagctcgtaggcggcttgtcacgtcggttgtgaaagcccggggcttaaccccgggtctgcagtcgatacgggcaggctagagtgtggtaggggagatcggaattcctggtgtagcggtgaaatgcgcagatatcaggaggaacaccggtggcgaaggcggatctctgggccattactgacgctgaggagcgaaagcgtggggagcgaacagg

SEQ ID NO: 190 - DNA, 254 bp, Unknown
  Kingdom: Bacteria, Phylum: Actinobacteria, Class: Actinobacteria, Order: Streptomycetales, Family: Streptomycetaceae, Genus:
atacgtagggcgcaagcgttgtccggaattattgggcgtaaagagctcgtaggcggcttgtcacgtcgggtgtgaaagcccggggcttaaccccgggtctgcattcgatacgggctggctagagtgtggtaggggagatcggaattcctggtgtagcggtgaaatgcgcagatatcaggaggaacaccggtggcgaaggcggatctctgggccattactgacgctgaggagcgaaagcgtggggagcgaacagg

SEQ ID NO: 191 - DNA, 254 bp, Unknown
  Kingdom: Bacteria, Phylum: Actinobacteria, Class: Actinobacteria, Order: Streptomycetales, Family: Streptomycetaceae, Genus:
atacgtagggtgcgagcgttgtccggaattattgggcgtaaagagctcgtaggcggcttgtcacgtcggttgtgaaagcccggggcttaaccccgggtctgcagtcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacagg

SEQ ID NO: 192 - DNA, 254 bp, Unknown
  Kingdom: Bacteria, Phylum: Actinobacteria, Class: Actinobacteria, Order: Streptomycetales, Family: Streptomycetaceae, Genus:
atacgtagggcgcaagcgttgtccggaattattgggcgtaaagagctcgtaggcggcttgtcgcgtcggatgtgaaagcccggggcttaaccccgggtctgcattcgatacgggcaggctagagtgtggtaggggagatcggaattcctggtgtagcggtgaaatgcgcagatatcaggaggaacaccggtggcgaaggcggatctctgggccattactgacgctgaggagcgaaagcgtggggagcgaacagg

SEQ ID NO: 193 - DNA, 254 bp, Unknown
  Kingdom: Bacteria, Phylum: Actinobacteria, Class: Actinobacteria, Order: Streptomycetales, Family: Streptomycetaceae, Genus:
atacgtagggtgcgagcgttgtccggaattattgggcgtaaagagctcgtaggcggcttgtcgcgtcggatgtgaaagcccggggcttaactccgggtctgcattcgatacgggcaggctagagtgtggtaggggagatcggaattcctggtgtagcggtgaaatgcgcagatatcaggaggaacaccggtggcgaaggcggatctctgggccattactgacgctgaggagcgaaagcgtggggagcgaacagg

SEQ ID NO: 194 - DNA, 254 bp, Unknown
  Kingdom: Bacteria, Phylum: Actinobacteria, Class: Actinobacteria, Order: Streptomycetales, Family: Streptomycetaceae, Genus:
atacgtagggcgcaagcgttgtccggaattattgggcgtaaagagctcgtaggcggcttgtcacgtcggatgtgaaagcccggggcttaaccccgggtctgcattcgatacgggctagctagagtgtggtaggggagatcggaattcctggtgtagcggtgaaatgcgcagatatcaggaggaacaccggtggcgaaggcggatctctgggccattactgacgctgaggagcgaaagcgtggggagcgaacagg

SEQ ID NO: 195 - DNA, 254 bp, Unknown
  Kingdom: Bacteria, Phylum: Actinobacteria, Class: Actinobacteria, Order: Streptomycetales, Family: Streptomycetaceae, Genus:
atacgtagggcgcgagcgttgtccggaattattgggcgtaaagagctcgtaggcggcttgtcacgtcgggtgtgaaagcccggggcttaaccccgggtctgcattcgatacgggctagctagagtgtggtaggggagatcggaattcctggtgtagcggtgaaatgcgcagatatcaggaggaacaccggtggcgaaggcggatctctgggccattactgacgctgaggagcgaaagcgtggggagcgaacagg

SEQ ID NO: 196 - DNA, 254 bp, Unknown
  Kingdom: Bacteria, Phylum: Actinobacteria, Class: Rubrobacteria, Order: Rubrobacterales, Family: Rubrobacteriaceae, Genus:
atacgtagggggcgagcgttgtccggaattattgggcgtaaagagcgtgtaggctgttcggtaagtctgccgtgaaaacctgaggctcaacctcgggcgtgcggtggatactgccgggctagaggacggtagaggcgagtggaattcccggtgtagcggtgaaatgcgcagatatcgggaggaacaccagtagcgaaggcggctcgctgggccgttcctgacgctgagacgcgaaagctaggggagcgaacagg

SEQ ID NO: 197 - DNA, 254 bp, Unknown
  Kingdom: Bacteria, Phylum: Actinobacteria, Class: Rubrobacteria, Order: Rubrobacterales, Family: Rubrobacteriaceae, Genus:
atacgtagggggcgagcgttgtccggaattattgggcgtaaagagcgtgtaggcggttcggtaagtctgccgtgaaaacctgaggctcaacctcgggcgtgcggtggatactgccgggctagaggacggtagaggcgagtggaattcccggtgtagcggtgaaatgcgcagatatcgggaggaacaccagtagcgaaggcggctcgctgggccgttcctgacgctgagacgcgaaagctaggggagcgaacagg

SEQ ID NO: 198 - DNA, 254 bp, Unknown
  Kingdom: Bacteria, Phylum: Actinobacteria, Class: Rubrobacteria, Order: Rubrobacterales, Family: Rubrobacteriaceae, Genus:
atacgtagggggcgagcgttgtccggaattattgggcgtaaagagcgtgtaggcggttcggtaagtctgccgtgaaaacctggggctcaaccccgggcgtgcggtggatactgccgggctagagggtggtagaggcgagtggaattcccggtgtagcggtgaaatgcgcagatatcgggaggaacaccagtagcgaaggcggctcgctgggccattcctgacgctgagacgcgaaagctaggggagcgaacagg

SEQ ID NO: 199 - DNA, 254 bp, Unknown
  Kingdom: Bacteria, Phylum: Actinobacteria, Class: Rubrobacteria, Order: Rubrobacterales, Family: Rubrobacteriaceae, Genus:
atacgtagggggcgagcgttgtccggatttattgggcgtaaagagcgtgtaggcggttcggtaagtctgtcgtgaaatcctgaggctcaacctcgggcgtgcgatggatactgccgggctagaggatggtagaggcgagtggaattcccggtgtagcggtgaaatgcgcagatatcgggaggaacaccagtagcgaaggcggctcgctgggccattcctgacgctgagacgcgaaagctaggggagcgaacagg

SEQ ID NO: 200 - DNA, 254 bp, Unknown
  Kingdom: Bacteria, Phylum: Actinobacteria, Class: Thermoleophilia, Order: Gaiellales, Family: Gaiellaceae, Genus:
atacgtagggggcaagcgttgtccggatttattgggcgtaaagagcgtgtaggcggccagacaggtccgttgtgaaaactagaggctcaacctctagacgtcgatggaaaccgtctggctagagtccggaagaggagagtggaattcctggtgtagcggtgaaatgcgcagatatcaggaagaacacccgtggctaaggcggctctctagtacggtactgacgctgagacgcgaaagcgtggggagcgaacagg

SEQ ID NO: 201 - DNA, 254 bp, Unknown
  Kingdom: Bacteria, Phylum: Actinobacteria, Class: Thermoleophilia, Order: Gaiellales, Family:  , Genus:
atacgtagggggcaagcgttgtccggatttattgggcgtaaagagcgtgtaggcggccatacaggtcagctgtgaaaactcgaggctcaacctcgagacgtcggttgaaaccgtatggctagagtccggaagaggagagtggaattcccggtgtagcggtgaaatgcgcagatatcgggaagaacacccgtggcgaaggcggctctctgggacggtactgacgctgagacgcgaaagcgtggggagcgaacagg

SEQ ID NO: 202 - DNA, 254 bp, Unknown
  Kingdom: Bacteria, Phylum: Actinobacteria, Class: Thermoleophilia, Order: Gaiellales, Family:  , Genus:
atacgtagggggcaagcgttgtccggatttattgggcgtaaagagcgtgtaggcggtttggtaggtccgctgtgaaaactcgaggctcaacctcgagacgccggtggaaaccatcagactagagtccggaagaggagagcggaattcctggtgtagcggtgaaatgcgcagatatcaggaagaacacccgtggctaaggcggctctctagtacggtactgacgctgagacgcgaaagcgtggggagcgaacagg

SEQ ID NO: 203 - DNA, 254 bp, Unknown
  Kingdom: Bacteria, Phylum: Actinobacteria, Class: Thermoleophilia, Order: Gaiellales, Family:  , Genus:
atacgtagggggcaagcgttgtccggatttattgggcgtaaagagcgtgtaggcggcctgaaaggtcagctgtgaaaactcgaggcttaacctcgagacgtcggttgaaaccatctggctagagtccggaagaggagtgtggaattcccggtgtagcggtgaaatgcgcagatatcgggaagaacacccgtggcgaaggcggcactctgggacggtactgacgctgagacgcgaaagcgtggggagcgaacagg

SEQ ID NO: 204 - DNA, 254 bp, Unknown
  Kingdom: Bacteria, Phylum: Actinobacteria, Class: Thermoleophilia, Order: Solirubrobacterales, Family: 0319-6M6, Genus:
atacgtagggggcaagcgttgtccggaatcattgggcgtaaagagcgcgtaggcggtccggtaagtccgctctgaaagtccggggctcaaccccgggaggcgggcggatactgccgggctagagtccggaagaggcgagtggaattcctggtgtagcggtgaaatgcgcagatatcaggaggaacaccgatggcgaaggcagctcgctgggacggtactgacgctgaggcgcgaaagcgtggggagcaaacagg

SEQ ID NO: 205 - DNA, 254 bp, Unknown
  Kingdom: Bacteria, Phylum: Actinobacteria, Class: Thermoleophilia, Order: Solirubrobacterales, Family: 480-2, Genus:
atacgtagggagcaagcgttgtccggaatcattgggcgtaaagcgcgcgtaggtggcttcgtaagcccgttgtgaaagtcaaaggctcaacctttgaaagccgatggatactgcggagctagagtacggaagaggcgagtggaattcctggtgtagcggtggaatgcgcagatatcaggaggaacaccaatagcgaaggcagctcgctgggacgttactgacactgaggcgcgaaagcgtggggagcgaacagg

SEQ ID NO: 206 - DNA, 254 bp, Unknown
  Kingdom: Bacteria, Phylum: Actinobacteria, Class: Thermoleophilia, Order: Solirubrobacterales, Family: 480-2, Genus:
atacgtagggggcaagcgttgtccggaatcattgggcgtaaagcgcgcgtaggcggccctgtaagtccgttgtgaaagtcaaaggctcaacctttgaaagccgatggatactgcagggctagagtccggaagaggcgagtggaattcctggtgtagcggtggaatgcgcagatatcaggaggaacaccaatagcgaaggcagctcgctgggacggtactgacgctaaggcgcgaaagcgtggggagcgaacagg

SEQ ID NO: 207 - DNA, 254 bp, Unknown
  Kingdom: Bacteria, Phylum: Actinobacteria, Class: Thermoleophilia, Order: Solirubrobacterales, Family: Patulibacteraceae, Genus:
atacgtagggcgcgagcgttgtccggaatcattgggcgtaaagcgcgtgtaggcggctgagtaagtctgctgtgaaagtccagggctcaaccctggaatgtcggcggatactgctcagctggagtacgggaggggcgagtggaattcctggtgtagcggtggaatgcgcagatatcaggaggaacacctatggcgaaggcagctcgctggaacgttactgacgctgagacgcgaaagcgtggggagcaaacagg

SEQ ID NO: 208 - DNA, 254 bp, Unknown
  Kingdom: Bacteria, Phylum: Actinobacteria, Class: Thermoleophilia, Order: Solirubrobacterales, Family: Solirubrobacteraceae, Genus:
atacgtagggggctagcgttgtccggaatcattgggcgtaaagagcgtgtaggcggcccggtaagtccgctgtgaaagtcgggggctcaaccctcgaatgccggtggatactgtcgggctagagtgcggaagaggcgagtggaattcctggtgtagcggtgaaatgcgcagatatcaggaggaacaccgattgcgaaggcagctcgctgggacgtaactgacgctgagacgcgaaagcgtggggagcaaacagg

SEQ ID NO: 209 - DNA, 254 bp, Unknown
  Kingdom: Bacteria, Phylum: Actinobacteria, Class: Thermoleophilia, Order: Solirubrobacterales, Family: Solirubrobacteraceae, Genus:
atacgtagggggctagcgttgtccggaatcattgggcgtaaagcgcgtgtaggcggcccggtaagtccgctgtgaaagtcgggggctcaaccctcggatgccggtggatactgtcgggctcgagtacggaagaggcgagtggaattcctggtgtagcggtgaaatgcgcagatatcaggaggaacaccaattgcgaaggcagctcgctgggacgttactgacgctgagacgcgaaagcgtggggagcaaacagg

SEQ ID NO: 210 - DNA, 254 bp, Unknown
  Kingdom: Bacteria, Phylum: Actinobacteria, Class: Thermoleophilia, Order: Solirubrobacterales, Family: Solirubrobacteraceae, Genus:
atacgtagggggctagcgttgtccggaatcattgggcgtaaagcgcgtgtaggcggtccggtaagtccgctgtgaaagtcgggggctcaaccctcgaaagccggtggatactgtcgggctagagtacggaagaggcgagtggaattcctggtgtagcggtgaaatgcgcagatatcaggaggaacaccaattgcgaaggcagctcgctgggacgttactgacgctgagacgcgaaagcgtggggagcaaacagg

SEQ ID NO: 211 - DNA, 251 bp, Unknown
  Kingdom: Bacteria, Phylum: Armatimonadetes, Class: Chthonomonadetes, Order: Chthonomonadales, Family: Chthonomonadaceae, Genus:
tacggggggggcgagcgttgtccgaagttactgggcgtaaagcgcgtgtaggcgggttgctaagtccgctgtgaaagcccggtgcttaacgccggagggtcggtggatactggcagtcttgaagtggctagggggaaatggaattaccggtgtagcggtgaaatgcgtagatatcggtaggaacaccagtggcgaaggcggtttcctggagctcttgacgctgagacgcgaaagctgggggagcaaacggg

SEQ ID NO: 212 - DNA, 255 bp, Unknown
  Kingdom: Bacteria, Phylum: Armatimonadetes, Class:  , Order:  , Family:  , Genus:
agacgtagggtccaagcgttgtccggatttactgggcgtaaagagcgcgtaggcggtctgttaagtgtgaagtgaaatctccagggctcaacccggaaactgcttcgcatactggcagacttgaggaatgcagaggtttgtggaattcctggtgtaacggtgaaatgtgttgatatcaggaggaacacccatggcgaaggcagcaaactgggcattatctgacgctgaggcgcgaaagcgtgggtagcaaacagg

SEQ ID NO: 213 - DNA, 254 bp, Unknown
  Kingdom: Bacteria, Phylum: Armatimonadetes, Class:  , Order:  , Family:  , Genus:
atacgtaggtggcaagcgttgtccggatttactgggtgtaaagggtgcgcaggcgggccattaagtagaaagtgaaaggttggagctcaactccgacactgcttcctatactggtggccttgagtttcggagggggaagcggaacgacacgtgtagcggtgaaatgcgttgatatgtgtcggaacaccaatggcgaaagcagcttcctggacgaatactgacgctcaggcacgaaagccaaggtagcaaacagg

SEQ ID NO: 214 - DNA, 254 bp, Unknown
  Kingdom: Bacteria, Phylum: Bacteroidetes, Class: Bacteroidia, Order: Bacteroidales, Family: Porphyromonadaceae, Genus:
atacggaggatgcgagcgttatccggatttattgggtttaaagggtgcgtaggcggcctgttaagtcagcggtgaaatctaggagcttaactcctaaattgccattgatactggcgggcttgagtgtagatgaggtaggcggaatgcgtggtgtagcggtggaatgcatagatatcacgcagaactccgattgcgaaggcagcttactaaggtacaactgacgctgaagcacgaaagcgtgggtatcaaacagg

SEQ ID NO: 215 - DNA, 254 bp, Unknown
  Kingdom: Bacteria, Phylum: Bacteroidetes, Class: Bacteroidia, Order: Bacteroidales, Family: Porphyromonadaceae, Genus:
atacggaggatgcgagcgttatccggatttattgggtttaaagggtgcgtaggtggtgatttaagtcagcggtgaaagtttgtggctcaaccataaaattgccgttgaaactgggttacttgagtgtgtttgaggtaggcggaatgcgtggtgtagcggtgaaatgcatagatatcacgcagaactccgattgcgaaggcagcttactaaaccataactgacactgaagcacgaaagcgtggggatcaaacagg

SEQ ID NO: 216 - DNA, 254 bp, Unknown
  Kingdom: Bacteria, Phylum: Bacteroidetes, Class: Bacteroidia, Order: Bacteroidales, Family: Prevotellaceae, Genus:
atacggaaggtccgggcgttatccggatttattgggtttaaagggagcgtaggctggagattaagtgtgttgtgaaatgtagacgctcaacgtctgacttgcagcgcatactggtttccttgagtacgcacaacgttggcggaattcgtcgtgtagcggtgaaatgcttagatatgacgaagaactccgattgcgaaggcagctgacgggagcgcaactgacgctgaagctcgaaggtgcgggtatcgaacagg

SEQ ID NO: 217 - DNA, 254 bp, Unknown
  Kingdom: Bacteria, Phylum: Bacteroidetes, Class: Bacteroidia, Order: Bacteroidales, Family: Prevotellaceae, Genus:
atacggaaggtccgggcgttatccggatttattgggtttaaagggagcgtaggccggagattaagcgtgttgtgaaatgtagatgctcaacatctgaactgcagcgcgaactggtttccttgagtacgcacaaagtgggcggaattcgtggtgtagcggtgaaatgcttagatatcacgaagaactccgattgcgaaggcagctcactggagcgcaactgacgctgaagctcgaaagtgcgggtatcgaacagg

SEQ ID NO: 218 - DNA, 254 bp, Unknown
  Kingdom: Bacteria, Phylum: Bacteroidetes, Class: Bacteroidia, Order: Bacteroidales, Family: Prevotellaceae, Genus:
atacggaaggtccaggcgttatccggatttattgggtttaaagggagcgtaggctggagattaagtgtgttgtgaaatgtagacgctcaacgtctgaattgcagcgcatactggtttccttgagtacgcacaacgttggcggaattcgtcgtgtagcggtgaaatgcttagatatgacgaagaactccgattgcgaaggcagctgacgggagcgcaactgacgcttaagctcgaaggtgcgggtatcaaacagg

SEQ ID NO: 219 - DNA, 253 bp, Unknown
  Kingdom: Bacteria, Phylum: Bacteroidetes, Class: Bacteroidia, Order: Bacteroidales, Family: Prevotellaceae, Genus:
atacggaaggtccaggcgttatccggatttattgggtttaaagggagcgtaggcggattattaagtcagtggtgaaagacggtggctcaaccatcgttagccattgaaactggtagtcttgagtgcagacagggatgctggaactcgtggtgtagcggtgaaatgcttagatatcacgatgaactccgatcgcgaaggcaggtgtccgggctgcaactgacgctgaggctcgaaagtgtgggtatcaaacagg

SEQ ID NO: 220 - DNA, 251 bp, Unknown
  Kingdom: Bacteria, Phylum: Bacteroidetes, Class: BME43, Order:  , Family:  , Genus:
tacggagggtgcaagcgttgtccggattcattgggtttaaagggtgcgtaggcggccctgtaagtcagcggtgaaatacccacgctcaacgtgggaactgccgttgatactgcggggcttgagttcgtgcgaggtcgctggaatgcgtggtgtagcggtgaaatgcatagatatcacgcagaacaccgattgcgaaggcaggtgactggcacgactgacgctgaggcacgaaagtgtggggagcaaacagg

SEQ ID NO: 221 - DNA, 254 bp, Unknown
  Kingdom: Bacteria, Phylum: Bacteroidetes, Class: Cytophagia, Order: Cytophagales, Family: Cyclobacteriaceae, Genus:
atacggagggtgcaagcgttgtccggatttattgggtttaaagggtgcgtaggcggctatttaagtcagcggtgaaagacatcggctcaaccgatgcagtgccattgatactggatagcttgagtgttggaggggtacatggaattgatggtgtagcggtgaaatgcatagataccatcaggaacaccgatagcgaaggcattgtactggccaacaactgacgctgaggcacgaaagcatgggtagcgaacagg

SEQ ID NO: 222 - DNA, 254 bp, Unknown
  Kingdom: Bacteria, Phylum: Bacteroidetes, Class: Cytophagia, Order: Cytophagales, Family: Cyclobacteriaceae, Genus:
atacggagggtgcaagcgttgtccggatttattgggtttaaagggtgcgtaggtggctcattaagtcagtgtttaaagtcaacagctcaactgttggaatggcattgatactgatgagcttgagtaaagttgaggtagacagaattgatggtgtagcggtgaaatgcatagatatcatcaagaataccgattgcgaaggcagtttactaagctttaactgacactgaggcacgaaagtgtggggatcaaacagg

SEQ ID NO: 223 - DNA, 251 bp, Unknown
  Kingdom: Bacteria, Phylum: Bacteroidetes, Class: Cytophagia, Order: Cytophagales, Family: Cytophagaceae, Genus:
tacggagggtgcaagcgttgtccggatttattgggtttaaagggtgcgtaggcggctgattaagtctggggtgaaagcccgttgctcaacaacggaactgccctggaaactggttagcttgagtacagacgagggtggcggaatggatgctgtagcggtgaaatgcatagatagcatccagaaccccgattgcgaaggcagctgcctagactgactgacgctgaggcacgaaagcgtggggagcgaacagg

SEQ ID NO: 224 - DNA, 251 bp, Unknown
  Kingdom: Bacteria, Phylum: Bacteroidetes, Class: Cytophagia, Order: Cytophagales, Family: Cytophagaceae, Genus:
tacgtaggtggcaagcgttgtccggatttattgggtttaaagggtgcgtaggcggttctatwagtcagtggtgaaatacggcagctcaactgtcgaggtgccattgatactgtggaacttgagtacagacgaggtaggcggaattgacggtgtagcggtgaaatgcttagatatcgtcaagaacaccgatagcgaaggcagcttactagactgactgacgctgaggcacgaaagtgtggggatcaaacggg

SEQ ID NO: 225 - DNA, 254 bp, Unknown
  Kingdom: Bacteria, Phylum: Bacteroidetes, Class: Cytophagia, Order: Cytophagales, Family: Cytophagaceae, Genus:
atacgtaggtggcaagcgttgtccggatttattgggtttaaagggtgcgtaggcggttttgtaagtcagtggtgaaatatgtcagcttaactgagagggtgccattgatactgcagaacttgagtacagatgaggtaggcggaattgacggtgtagcggtgaaatgcttagatatcgtcaagaacacctatagcgaaggcagcttactaggctgtaactgacgctgaggcacgaaagtgtggggatcaaacagg

SEQ ID NO: 226 - DNA, 254 bp, Unknown
  Kingdom: Bacteria, Phylum: Bacteroidetes, Class: Cytophagia, Order: Cytophagales, Family: Cytophagaceae, Genus:
atacgtaggtggcaagcgttgtccggatttattgggtttaaagggtgcgtaggcggtcttttaagtcagtgctgaaatactccagcttaactggaggggtggcattgatactggaagacttgagtgtagtcgaggtaggcggaattgacggtgtagcggtgaaatgcttagatatcgtcaagaacaccgatagtgaagacagcttactaggctacaactgacgctgaggcacgaaagtgtggggatcaaacagg

SEQ ID NO: 227 - DNA, 254 bp, Unknown
  Kingdom: Bacteria, Phylum: Bacteroidetes, Class: Cytophagia, Order: Cytophagales, Family: Cytophagaceae, Genus:
atacgtaggtggcaagcgttgtccggatttattgggtttaaagggtgcgtaggcggttgtataagtcagtgctgaaatatcccggcttaaccgggagggtggcattgatactgtatgacttgagtaaagttgaggttggcggaattgacggtgtagcggtgaaatgcttagatatcgtcaagaacaccgatagcgaaggcagctaactaagctttaactgacgctgaggcacgaaagtgtggggatcaaacagg

SEQ ID NO: 228 - DNA, 251 bp, Unknown
  Kingdom: Bacteria, Phylum: Bacteroidetes, Class: Cytophagia, Order: Cytophagales, Family: Cytophagaceae, Genus:
tacggagggtgcgagcgttgtccggatttattgggtttaaagggtgcgtaggcggccgtttaagtctggggtgaaagcccgctgctcaacagcggaactgccctggatactggatggcttgagtacagacgaggttggcggaatggacggagtagcggtgaaatgcatagataccgtccagaaccccgattgcgaaggcagctgactaggctgactgacgctgaggcacgaaagcgtggggagcgaacagg

SEQ ID NO: 229 - DNA, 251 bp, Unknown
  Kingdom: Bacteria, Phylum: Bacteroidetes, Class: Cytophagia, Order: Cytophagales, Family: Cytophagaceae, Genus:
tacgtaggtggcaagcgttgtccggatttattgggtttaaagggtgcgtaggtggttccataagtcagtggtgaaatacggcagcttaactgtcgaggtgccattgatactgcggaacttgagtacagacgaggtaggcggaattgacggtgtagcggtgaaatgcttagatatcgtcaagaacaccgatagcgaaggcagcttactagactgactgacactgaggcacgaaagtgtggggatcaaacagg

SEQ ID NO: 230 - DNA, 254 bp, Unknown
  Kingdom: Bacteria, Phylum: Bacteroidetes, Class: Cytophagia, Order: Cytophagales, Family: Cytophagaceae, Genus:
atacgtaggtggcaagcgttgtccggatttattgggtttaaagggtgcgtaggcggtcctataagtcagtgctgaaatatcccggcttaaccgggagggtggcattgatactgcaggacttgagtaaagttgaggttggcggaattgacggtgtagcggtgaaatgcttagatatcgtcaagaacacctattgcgaaggcagctaactaagctttaactgacgctgaggcacgaaagtgtggggatcaaacagg

SEQ ID NO: 231 - DNA, 254 bp, Unknown
  Kingdom: Bacteria, Phylum: Bacteroidetes, Class: Cytophagia, Order: Cytophagales, Family: Cytophagaceae, Genus:
atacgtaggtggcaagcgttgtccggatttattgggtttaaagggtgcgtaggcggtctattaagtcagtgctgaaatatcccggcttaaccgggagggtggcattgatactgatggacttgagttcagtcgaggtaggcggaattgacggtgtagcggtgaaatgcttagatatcgtcaagaacaccgatagtgtagacagcttactaggctgaaactgacgctgaggcacgaaagtgtggggatcaaacagg

SEQ ID NO: 232 - DNA, 251 bp, Unknown
  Kingdom: Bacteria, Phylum: Bacteroidetes, Class: Cytophagia, Order: Cytophagales, Family: Cytophagaceae, Genus:
tacggagggtgcaagcgttgtccggatttattgggtttaaagggtgcgtaggtggctctataagtcagtggtgaaagcctgcagcttaactgtaggactgccattgatactgtggagcttgagtactgatgaggtaggcggaattgatagtgtagcggtgaaatgcatagatattatcaagaacaccgattgcgaaggcagcttactaaggagactgacactgaggcacgaaagcgtggggatcaaacagg

SEQ ID NO: 233 - DNA, 254 bp, Unknown
  Kingdom: Bacteria, Phylum: Bacteroidetes, Class: Cytophagia, Order: Cytophagales, Family: Cytophagaceae, Genus:
atacgtaggtggcaagcgttgtccggatttattgggtttaaagggtgcgtaggcggtcctataagtcagtggtgaaatacggcagcttaactgtcgaggtgccattgatactgcaggactagagtactgatgaggtaggcggaatggacggtgtagcggtgaagtgcttagatatcgtccagaacaccgatagcgaaggcagcttactaaggagtaactgacgctgaggcacgaaagtgtggggatcaaacagg

SEQ ID NO: 234 - DNA, 254 bp, Unknown
  Kingdom: Bacteria, Phylum: Bacteroidetes, Class: Cytophagia, Order: Cytophagales, Family: Cytophagaceae, Genus:
atacggagggtgcgagcgttgtccggatttattgggtttaaagggtgcgtaggcggcccgttaagtccggggtgaaagcccgttgctcaacaacggaactgccctggatactgacgggcttgagtacagacgaggttggcggaatggaccgagtagcggtgaaatgcatagatacggtccagaaccccgattgcgaaggcagctgactaggctgttactgacgctgaggcacgacagcgtggggagcgaacagg

SEQ ID NO: 235 - DNA, 254 bp, Unknown
  Kingdom: Bacteria, Phylum: Bacteroidetes, Class: Cytophagia, Order: Cytophagales, Family: Cytophagaceae, Genus:
atacggagggtgcgagcgttgtccggatttattgggtttaaagggtgcgtaggtggctttataagtcagtggtgaaatacagccgctcaacggttgaggtgccattgatactgtagagcttgaaacaattggaggctgccggaatggatggtgtagcggtgaaatgcatagatatcatccagaacaccgattgcgaaggcaggtggctacgtttgatttgacactgaggcacgaaagcatggggagcaaacagg

SEQ ID NO: 236 - DNA, 253 bp, Unknown
  Kingdom: Bacteria, Phylum: Bacteroidetes, Class: Cytophagia, Order: Cytophagales, Family: Cytophagaceae, Genus:
tacgtagggtgcaagcgttgtccggatttattgggtttaaagggtgcgtaggcggtttattaagtcagtggtgaaagacgatcgctcaacgattgcagtgccattgatactggtaaacttgagtagtgcagaggtagctggaattgatcgtgtagcggtgaaatgcatagatatgatcaagaacgccaattgcgaaggcaggttactggacactcactgacgctgaggcacgaaagtgtggggatcaaacagg

SEQ ID NO: 237 - DNA, 251 bp, Unknown
  Kingdom: Bacteria, Phylum: Bacteroidetes, Class: Cytophagia, Order: Cytophagales, Family: Cytophagaceae, Genus:
tacgtaggtggcaagcgttgtccggatttattgggtttaaagggtgcgtaggcggttctataagtcagtggtgaaatccggcagctcaactgtcgatgtgccattgatactgcagaacttgagtacagacgaggtaggcggaattgacggtgtagcggtgaaatgcttagatatcgtcaagaacaccgatagcgaaggcagcttactagactgactgacgctgacgcacgaaagtgtggggatcaaacagg

SEQ ID NO: 238 - DNA, 254 bp, Unknown
  Kingdom: Bacteria, Phylum: Bacteroidetes, Class: Cytophagia, Order: Cytophagales, Family: Cytophagaceae, Genus:
atacggagggtgcaagcgttgtccggatttattgggtttaaagggtgcgtaggcggctgattaagtctggggtgaaagcccgttgctcaacaacggaactgccctggaaactggttagcttgagtacagacgagggtggcggaatggatgctgtagcggtgaaatgcatagatagcatccagaaccccgattgcgaaggcagctgcctagactgtaactgacgctgaggcacgaaagcgtggggagcgaacagg

SEQ ID NO: 239 - DNA, 254 bp, Unknown
  Kingdom: Bacteria, Phylum: Bacteroidetes, Class: Cytophagia, Order: Cytophagales, Family: Cytophagaceae, Genus:
atacggagggtgcgagcgttgtccggatttattgggtttaaagggtgcgtaggtggctttttaagtcagtggtgaaatacagccgctcaacggttgaggtgccattgatactgaagagcttgaaacaagtggaggctgccggaatggatggtgtagcggtgaaatgcatagatatcatccagaacaccgattgcgaaggcaggtggctacgtttgatttgacactgaggcacgaaagcatggggagcaaacagg

SEQ ID NO: 240 - DNA, 254 bp, Unknown
  Kingdom: Bacteria, Phylum: Bacteroidetes, Class: Cytophagia, Order: Cytophagales, Family: Cytophagaceae, Genus:
atacggagggtgcgagcgttgtccggatttattgggtttaaagggtgcgtaggtggcctgttaagtcagtggtgaaatacggttgctcaacaatcgaggtgccattgatactgaccggcttgaaataattggaggctgccggaatggatggtgtagcggtgaaatgcatagatatcatccagaacaccgattgcgaaggcaggtggctacgatttgtttgacactgaggcacgaaagcatggggagcaaacagg

SEQ ID NO: 241 - DNA, 254 bp, Unknown
  Kingdom: Bacteria, Phylum: Bacteroidetes, Class: Cytophagia, Order: Cytophagales, Family: Cytophagaceae, Genus:
atacgtaggtggcaagcattgtccggatttattgggtttaaagggtgcgtaggcggccttgtaagtcagtggtgaaatactccagcttaactggaggggtgccaatgatactgcagggcttgagtacagatgaggtaggcggaattgacggtgtagcggtgaaatgcatagatatcgtcaagaacacctatagcgaaggcagcttactgggctgtaactgacgctgaggcacgaaagtgtggggatcaaacagg

SEQ ID NO: 242 - DNA, 254 bp, Unknown
  Kingdom: Bacteria, Phylum: Bacteroidetes, Class: Cytophagia, Order: Cytophagales, Family: Cytophagaceae, Genus:
atacggagggtgcaagcgttgtccggatttattgggtttaaagggtgcgtaggcggtttattaagtcagtggtgaaagacggtcgctcaacgattgcagtgccattgatactggtagacttgagtatgattgaggtagctggaatggatagtgtagcggtgaaatgcatagatattatccagaacaccaattgcgtaggcaagttactaagtcataactgacgctgatgcacgaaagtgtgggtatcaaacagg

SEQ ID NO: 243 - DNA, 254 bp, Unknown
  Kingdom: Bacteria, Phylum: Bacteroidetes, Class: Cytophagia, Order: Cytophagales, Family: Cytophagaceae, Genus:
atacggagggtgcaagcgttgtccggatttattgggtttaaagggtgcgtaggcggcccgttaagtcagtggtgaaagcctccagctcaactggagaactgccattgatactgacgggcttgagtacagacgaggttggcggaattgattgtgtagcggtgaaatgcatagatacaatcaagaactccgattgcgtaggcagctaactaggctgtaactgacgctgaggcacgaaagcgtggggagcgaacagg

SEQ ID NO: 244 - DNA, 251 bp, Unknown
  Kingdom: Bacteria, Phylum: Bacteroidetes, Class: Cytophagia, Order: Cytophagales, Family: Cytophagaceae, Genus:
tacggagggtgcaagcgttgtccggatttattgggtttaaagggtgcgcaggtgggtatttaagtctggtttgaaagcaggtggctcaaccatctgatgtggctggaaactggatatcttgaatgggttggcggtagccggaatgggtcatgtagcggtgaaatgcatagatatgacccggaacaccgattgcgaaggcaggctactacgactattgacactgaggcacgagagcatgggtagcgaacagg

SEQ ID NO: 245 - DNA, 254 bp, Unknown
  Kingdom: Bacteria, Phylum: Bacteroidetes, Class: Cytophagia, Order: Cytophagales, Family: Cytophagaceae, Genus:
atacggagggtgcgagcgttgtccggatttattgggtttaaagggtgcgtaggcggccgtttaagtctggggtgaaagcccgctgctcaacagcggaactgccctggatactggatggcttgagtacagacgaggttggcggaatggaccgagtagcggtgaaatgcatagatacggtccagaaccccgattgcgaaggcagctgactaggctgttactgacgctgaggcacgaaagcgtggggagcgaacagg

SEQ ID NO: 246 - DNA, 251 bp, Unknown
  Kingdom: Bacteria, Phylum: Bacteroidetes, Class: Cytophagia, Order: Cytophagales, Family: Cytophagaceae, Genus:
tacgtaggtggcaagcgttgtccggatttattgggtttaaagggtgcgtaggcggctatctaagtcagtggtgaaatatctcagcttaactgagagggtgccattgatactggatagcttgagtacagatgaggtaggcggaattgacggtgtagcggtgaaatgcatagatatcgtcaagaacaccgatagcgaaggcagcttaccaagctgactgacgctgaggcacgaaagtgtggggatcaaacagg

SEQ ID NO: 247 - DNA, 254 bp, Unknown
  Kingdom: Bacteria, Phylum: Bacteroidetes, Class: Cytophagia, Order: Cytophagales, Family: Cytophagaceae, Genus:
atacggagggtgcaagcgttgtccggatttattgggtttaaagggtgcgcaggtgggtatttaagtctggtttgaaagcaggtggctcaaccatctgatgtggctggaaactggatatcttgaatgggttggcggtagccggaatgggtcatgtagcggtgaaatgcatagatatgacccggaacaccgattgcgaaggcaggctactacgacttgattgacactgaggcacgagagcatgggtagcgaacagg

SEQ ID NO: 248 - DNA, 251 bp, Unknown
  Kingdom: Bacteria, Phylum: Bacteroidetes, Class: Cytophagia, Order: Cytophagales, Family: Cytophagaceae, Genus:
tacggagggtgcgagcgttgtccggatttattgggtttaaagggtgcgtaggcggccgtttaagtccggggtgaaagcccgctgctcaacagcggaactgccctggatactggatggcttgagtacagacgaggttggcggaatggactgagtagcggtgaaatgcatagatacagtccagaaccccgattgcgaaggcagctgactaggctgactgacgctgaggcacgaaagcgtggggagcgaacagg

SEQ ID NO: 249 - DNA, 251 bp, Unknown
  Kingdom: Bacteria, Phylum: Bacteroidetes, Class: Cytophagia, Order: Cytophagales, Family: Cytophagaceae, Genus:
tacggagggtgcgagcgttgtccggatttattgggtttaaagggtgcgtaggcggccttttaagtccggggtgaaagcccgttgctcaacaacggaactgccctggatactggaaggcttgagtacagacgaggttggcggaatggactgagtagcggtgaaatgcatagatacagtccagaaccccgattgcgaaggcagctgactaggctgactgacgctgaggcacgaaagcgtggggagcgaacagg

SEQ ID NO: 250 - DNA, 251 bp, Unknown
  Kingdom: Bacteria, Phylum: Bacteroidetes, Class: Cytophagia, Order: Cytophagales, Family: Cytophagaceae, Genus:
tacggagggtgcgagcgttgtccggatttattgggtttaaagggtgcgtaggcggcccgttaagtccggggtgaaagcccgctgctcaacagcggaactgccctggatactgacgggcttgagtacagacgaggttggcggaatggaccgagtagcggtgaaatgcatagatacggtccagaaccccgattgcgaaggcagctgactaggctgactgacgctgaggcacgaaagcgtggggagcgaacagg

SEQ ID NO: 251 - DNA, 255 bp, Unknown
  Kingdom: Bacteria, Phylum: Bacteroidetes, Class: Cytophagia, Order: Cytophagales, Family: Cytophagaceae, Genus:
atacgtaggtggcgagcgttatccggatttattgggtttaaagggtgcgtaggcggctgattaagtcagcggtgaaaggtagcagcttaactgttttacatgccgttgatactggttagcttgagttgacagaaggcagatagaatttctggtgtagcggtgaaatgcttagataccaggaggaataccgattgcgaaggcagtctgctgcagtcacactgacgctgaggcacgaaagtgcggggatcaaacagg

SEQ ID NO: 252 - DNA, 254 bp, Unknown
  Kingdom: Bacteria, Phylum: Bacteroidetes, Class: Cytophagia, Order: Cytophagales, Family: Cytophagaceae, Genus:
atacgtaggtggcaagcgttgtccggatttattgggtttaaagggtgcgtaggcggcttgataagtcagtggtgaaagccgatcgcttaacgatcgaactgccattgatactgtcgggcttgagtatagttgaggtaggcggaattgacagtgtagcggtgaaatgcatagatattgtcaagaacaccaattgcgaaggcagcttactaaagtataactgacgctgaggcacgaaagtgcggggatcaaacagg

SEQ ID NO: 253 - DNA, 251 bp, Unknown
  Kingdom: Bacteria, Phylum: Bacteroidetes, Class: Cytophagia, Order: Cytophagales, Family: Cytophagaceae, Genus:
tacgtaggtggcaagcgttgtccggatttattgggtttaaagggtgcgtaggcggcctattaagtcagtggtgaaatatttcagcttaactggaattgtgccattgatactgatgggcttgagtacagatgaggtaggcggaattgacggtgtagcggtgaaatgcttagatatcgtcaagaacacctatagcgaaggcagcttactaggctgactgacgctgaggcacgaaagtgtggggatcaaacagg

SEQ ID NO: 254 - DNA, 254 bp, Unknown
  Kingdom: Bacteria, Phylum: Bacteroidetes, Class: Cytophagia, Order: Cytophagales, Family: Cytophagaceae, Genus:
atacggagggtgcaagcgttgtccggatttattgggtttaaagggtgcgtaggtggcttgttaagtccggggtgaaagcccacagctcaactgtggaactgccctggatactggcgagcttgagtccagacgaggttggcggaatggaagctgtagcggtgaaatgcatagatagcttccagaaccccgattgcgtaggcagctgactaggctggtactgacactgaggcacgaaagcgtggggagcgaacagg

SEQ ID NO: 255 - DNA, 251 bp, Unknown
  Kingdom: Bacteria, Phylum: Bacteroidetes, Class: Cytophagia, Order: Cytophagales, Family: Cytophagaceae, Genus:
tacggagggtgcgagcgttgtccggatttattgggtttaaagggtgcgtaggtggcctgttaagtcagtggtgaaatacggttgctcaacaatcgaggtgccattgatactgaccggcttgaaataattggaggctgccggaatggatggtgtagcggtgaaatgcatagatatcatccagaacaccgattgcgaaggcaggtggctacgatttttgacactgaggcacgaaagcatggggagcaaacagg

SEQ ID NO: 256 - DNA, 252 bp, Unknown
  Kingdom: Bacteria, Phylum: Bacteroidetes, Class: Cytophagia, Order: Cytophagales, Family: Cytophagaceae, Genus:
atacgtaggtggcaagcgttgtccggatttattgggtttaaagggtgcgtaggcggttgattaagtcagttgtgaaatacggcagcttaactgtcgaggtgcaattgatactggttgacttgagtacagacgaggtaggcggaattgacggtgtagcggtgaaatgcatagatatcgtcaagaacaccgatagcgaagcagcttactagactgtaactgacgctgagcacgaaagtgtggggatcaaacagg

SEQ ID NO: 257 - DNA, 254 bp, Unknown
  Kingdom: Bacteria, Phylum: Bacteroidetes, Class: Cytophagia, Order: Cytophagales, Family: Cytophagaceae, Genus:
atacgtaggtggcaagcgttgtccggatttattgggtttaaagggtgcgtaggtggccctgtaagtcagtggtgaaatatctcagcttaactgagagggtgccattgatactgcagggcttgagtacagatgaggtaggcggaattgacggtgtagcggtgaaatgcatagatatcgtcaagaacaccgatagcgaaggcagcttaccaagctgtaactgacactgaggcacgaaagtgtggggatcaaacagg

SEQ ID NO: 258 - DNA, 251 bp, Unknown
  Kingdom: Bacteria, Phylum: Bacteroidetes, Class: Cytophagia, Order: Cytophagales, Family: Cytophagaceae, Genus:
tacggagggtgcgagcgttgtccggatttattgggtttaaagggtgcgtaggcggcctgttaagtccggggtgaaagcccgttgctcaacaacggaactgccctggatactgccaggcttgagtacagacgaggttggcggaatggaccgagtagcggtgaaatgcatagatacggtccagaaccccgattgcgaaggcagctgactaggctgactgacgctgaggcacgacagcgtggggagcgaacagg

SEQ ID NO: 259 - DNA, 254 bp, Unknown
  Kingdom: Bacteria, Phylum: Bacteroidetes, Class: Cytophagia, Order: Cytophagales, Family: Cytophagaceae, Genus:
atacgtaggtggcaagcgttgtccggatttattgggtttaaagggtgcgtaggcggccttataagtcagtgctgaaatatcccggcttaaccgggagggtggcattgatactgtagggcttgagtaaagttgaggtaggcggaattgacggtgtagcggtgaaatgcttagatatcgtcaagaacaccgatagtgaagacagcttactaaactttaactgacgctgaggcacgaaagtgtggggatcaaacagg

SEQ ID NO: 260 - DNA, 254 bp, Unknown
  Kingdom: Bacteria, Phylum: Bacteroidetes, Class: Cytophagia, Order: Cytophagales, Family: Cytophagaceae, Genus:
atacggagggtgcgagcgttgtccggatttattgggtttaaagggtgcgtaggtggctgtttaagtcagtggtgaaatacggttgctcaacaatcgaggtgccattgatactgaatagcttgaaataattggaggctgccggaatggatggtgtagcggtgaaatgcatagatatcatccagaacaccgattgcgaaggcaggtggctacgatttgtttgacactgaggcacgaaagcatggggagcaaacagg

SEQ ID NO: 261 - DNA, 254 bp, Unknown
  Kingdom: Bacteria, Phylum: Bacteroidetes, Class: Cytophagia, Order: Cytophagales, Family: Cytophagaceae, Genus:
atacgtaggtggcgagcgttgtccggatttattgggtttaaagggtgcgtaggcggctctataagtcagtgctgaaatatcccggcttaaccgggagggtggcattgatactgcagagcttgagtaaagttgaggtgggcggaattgacggtgtagcggtgaaatgcttagatatcgtcaagaacaccgattgcgaaggcagctcactaagctttaactgacgctgaggcacgaaagtgtggggatcaaacagg

SEQ ID NO: 262 - DNA, 254 bp, Unknown
  Kingdom: Bacteria, Phylum: Bacteroidetes, Class: Cytophagia, Order: Cytophagales, Family: Cytophagaceae, Genus:
atacggagggtgcgagcgttgtccggatttattgggtttaaagggtgcgtaggcggccttataagtccggggtgaaagcccgttgctcaacaacggaactgccctggatactgtgaggcttgagtacagacgaggttggcggaatggaccgagtagcggtgaaatgcatagatacggtccagaaccccgattgcggaggcagctgactaggctgttactgacgctgaggcacgacagcgtggggagcgaacagg

SEQ ID NO: 263 - DNA, 254 bp, Unknown
  Kingdom: Bacteria, Phylum: Bacteroidetes, Class: Cytophagia, Order: Cytophagales, Family: Cytophagaceae, Genus:
atacgtaggtggcaagcgttgtccggatttattgggtttaaagggtgcgtaggttgttttgtaagtcagtggtgaaatccggcagctcaactgtcgatgtgccattgatactgcagaacttgagtacagacgaggtaggcggaattgacggtgtagcggtgaaatgcttagatatcgtcaagaacaccgatagcgaaggcagcttactagactgtaactgacactgatgcacgaaagtgtggggatcaaacagg

SEQ ID NO: 264 - DNA, 251 bp, Unknown
  Kingdom: Bacteria, Phylum: Bacteroidetes, Class: Cytophagia, Order: Cytophagales, Family: Cytophagaceae, Genus:
tacggagggtgcaagcgttgtccggatttattgggtttaaagggtgcgtaggtggaactgtaagtctgatttgaaagcaagcggcttaaccgtttgatgtggttggaaactgtggttcttgaatgggttggcggtagccggaatgggtcatgtagcggtgaaatgcatagatatgacccggaacaccgattgcgaaggcaggctactacgactattgacactgaggcacgagagcatgggtagcgaacagg

SEQ ID NO: 265 - DNA, 254 bp, Unknown
  Kingdom: Bacteria, Phylum: Bacteroidetes, Class: Cytophagia, Order: Cytophagales, Family: Cytophagaceae, Genus:
atacggagggtgcgagcgttgtccggatttattgggtttaaagggtgcgtaggcggcccgttaagtccggggtgaaagcccgctgctcaacagcggaactgccctggatactgacgggcttgagtacagacgaggttggcggaatggactgagtagcggtgaaatgcatagatacagtccagaaccccgattgcgaaggcagctgactaggctgttactgacgctgaggcacgaaagcgtggggagcgaacagg

SEQ ID NO: 266 - DNA, 251 bp, Unknown
  Kingdom: Bacteria, Phylum: Bacteroidetes, Class: Cytophagia, Order: Cytophagales, Family: Cytophagaceae, Genus:
tacgtaggtggcaagcgttggccggatttattgggtttaaagggtgcgtaggcggccccataagtcagtgctgaaatactctagcttaactagaggggtggcattgatactgcggggcttgagtgtagtcgaggtaggcggaattgacggtgtagcggtgaaatgcttagatatcgtcaagaacaccgatagtgtagacagcttactaggctaactgacgctgaggcacgaaagtgtggggatcaaacagg

SEQ ID NO: 267 - DNA, 251 bp, Unknown
  Kingdom: Bacteria, Phylum: Bacteroidetes, Class: Cytophagia, Order: Cytophagales, Family: Cytophagaceae, Genus:
tacggagggtgcaagcgttgtccggatttattgggtttaaagggtgcgtaggcggccgattaagtctggggtgaaagcccgttgctcaacaacggaactgccctggaaactggttggcttgagtacagacgaggttggcggaatggatgctgtagcggtgaaatgcatagatagcatccagaaccccgattgcgaaggcagctgactaggctgactgacgctgaggcacgaaagcgtggggagcgaacagg

SEQ ID NO: 268 - DNA, 251 bp, Unknown
  Kingdom: Bacteria, Phylum: Bacteroidetes, Class: Cytophagia, Order: Cytophagales, Family: Cytophagaceae, Genus:
tacggagggtgcgagcgttgtccggatttattgggtttaaagggtgcgtaggcggccttataagtccggggtgaaagcccgttgctcaacaacggaactgccctggatactgtgaggcttgagtacagacgaggttggcggaatggaccgagtagcggtgaaatgcatagatacggtccagaaccccgattgcgaaggcagctgactaggctgactgacgctgaggcacgacagcgtggggagcgaacagg

SEQ ID NO: 269 - DNA, 251 bp, Unknown
  Kingdom: Bacteria, Phylum: Bacteroidetes, Class: Cytophagia, Order: Cytophagales, Family: Cytophagaceae, Genus:
tacggagggtgcaagcgttgtccggatttattgggtttaaagggtgcgtaggtgggacttcaagtctggtttgaaagctggtggctcaaccatcagatgtggctggaaactgaggttcttgaatggcgtagcggtagccggaatgggtcatgtagcggtgaaatgcatagatatgacccggaacaccgattgcgaaggcaggctactgggcgtattgacactgaggcacgagagcatgggtagcaaacagg

SEQ ID NO: 270 - DNA, 251 bp, Unknown
  Kingdom: Bacteria, Phylum: Bacteroidetes, Class: Cytophagia, Order: Cytophagales, Family: Cytophagaceae, Genus:
tacgtaggtggcaagcgttgtccggatttattgggtttaaagggtgcgtaggcggctttgtaagtcagtggtgaaatacggcagctcaactgtcgaggtgccattgatactgcagagctagagtactgatgaggtaggcggaatggacggtgtagcggtgaaatgcttagatatcgtccagaacaccgatagcgaaggcagcttactaaagagactgacgctgaggcacgaaagtgtggggatcaaacagg

SEQ ID NO: 271 - DNA, 254 bp, Unknown
  Kingdom: Bacteria, Phylum: Bacteroidetes, Class: Cytophagia, Order: Cytophagales, Family: Cytophagaceae, Genus:
atacggagggtgcgagcgttgtccggatttattgggtttaaagggtgcgtaggcggctccttaagtccggggtgaaagcccgttgctcaacaacggaactgccctggatactgaggagcttgagtacagacgaggttggcggaatggactgagtagcggtgaaatgcatagatacagtccagaaccccgattgcgaaggcagctgactaggctgttactgacgctgaggcacgacagcgtggggagcgaacagg

SEQ ID NO: 272 - DNA, 254 bp, Unknown
  Kingdom: Bacteria, Phylum: Bacteroidetes, Class: Cytophagia, Order: Cytophagales, Family: Cytophagaceae, Genus:
atacgtaggtggcaagcgttgtccggatttattgggtttaaagggtgcgtaggcggttccataagtcagtggtgaaatacaatagcttaactattgaggtgccattgatactgcggaacttgagtacagacgaggtaggcggaattgacggtgtagcggtgaaatgcttagatatcgtcaagaacaccgatagcgaaggcagcttactagactgtaactgacgctgaggcacgaaagtgtggggatcaaacagg

SEQ ID NO: 273 - DNA, 254 bp, Unknown
  Kingdom: Bacteria, Phylum: Bacteroidetes, Class: Cytophagia, Order: Cytophagales, Family: Cytophagaceae, Genus:
atacgtaggtggcaagcgttgtccggatttattgggtttaaagggtgcgtaggcggccctgtaagtcagtgctgaaatatcccagcttaactgggagggtggcattgatactgcggggctagagtacagatgaggtaggcggaattgacggtgtagcggtgaaatgcttagatatcgtcaagaacacctatagcgaaggcagcttactaggctgtaactgacgctgaggcacgaaagtgtggggatcaaacagg

SEQ ID NO: 274 - DNA, 254 bp, Unknown
  Kingdom: Bacteria, Phylum: Bacteroidetes, Class: Cytophagia, Order: Cytophagales, Family: Flammeovirgaceae, Genus: Marinoscillum
atacggagggtgcaagcgttgtccggattcattgggtttaaagggtgcgtaggcgggttattaagtcagtggtgaaagccgacagctcaactgtcgaactgccattgatactggtaaccttgaattcagttgaggtaggcggaattgatggtgtagcggtgaaatgcatagataccatcaggaacaccgattgcgaaggcagcttactgggcttgaattgacgctgaggcacgaaagcgtggggatcgaacagg

SEQ ID NO: 275 - DNA, 254 bp, Unknown
  Kingdom: Bacteria, Phylum: Bacteroidetes, Class: Cytophagia, Order: Cytophagales, Family: Flammeovirgaceae, Genus:
atacggagggtgcaagcgttgtccggatttattgggtttaaagggtgcgtaggcggctaattaagtcagtggtgaaagcctgtagctcaactatagaattgccattgatactgattagcttgagtttggttgaggtaggcggaatggatggtgtagcggtgaaatgcatagatatcatccagaacaccgatagcgaaggcagcttactgagccgaaactgacgctgaggcacgaaagcatggggatcgaacagg

SEQ ID NO: 276 - DNA, 254 bp, Unknown
  Kingdom: Bacteria, Phylum: Bacteroidetes, Class: Cytophagia, Order: Cytophagales, Family: Flammeovirgaceae, Genus:
atacggagggtgcaagcgttgtccggatttattgggtttaaagggtacgtaggtgggtctttaagtccgtggtgaaagccaacagcttaactgttgaactgccatggatactggagaccttgaattcagttgaggttggcggaatttatggtgtagcggtgaaatgcatagataccataaagaacacctattgcgaaggcagctaactggacttgaattgacactgaggtacgaaagcgtggggagcgaacagg

SEQ ID NO: 277 - DNA, 254 bp, Unknown
  Kingdom: Bacteria, Phylum: Bacteroidetes, Class: Cytophagia, Order: Cytophagales, Family: Flammeovirgaceae, Genus:
atacggagggtgcaagcgttatccggatttactgggtttaaagggtgcgtaggcggctctttaagtcagtggtgaaagcctagtgcttaacactagaattgccattgaaactgaagagcttgagtcaaggagaggtaagcagaatttatggtgtagcagtgaaatgcttagataccataaggaataccaatagcgaaggcagcttactggccttgtactgacgctgaggcacgaaagcgtggggagcaaacagg

SEQ ID NO: 278 - DNA, 255 bp, Unknown
  Kingdom: Bacteria, Phylum: Bacteroidetes, Class: Flavobacteriia, Order: Flavobacteriales, Family: Cryomorphaceae, Genus:
atacggagggtgcaagcgttatccggaatcattgggtttaaagggtccgcaggcggtcttataagtcagtggtgaaagcctacagctcaactgtagaactgccattgatactgtaagacttgaattcgatcgaagtgggcggaatatgacatgtagcggtgaaatgcttagatatgtcatagaacaccgatagcgaaggcagctcactaggtctggattgacgctcagggacgaaagcgtgggggagcaaacagg

SEQ ID NO: 279 - DNA, 253 bp, Unknown
  Kingdom: Bacteria, Phylum: Bacteroidetes, Class: Flavobacteriia, Order: Flavobacteriales, Family: Cryomorphaceae, Genus:
atacggagggtgcaagcgttatccggaatcattgggtttaaagggtccgcaggcgggaagataagtcagtggtgaaatctcacagctcaactgtgaaactgccattgatactgtctttcttgaattcgatcgaagtgggcggaatgtgacatgtagcggtgaaatgcttagatatgtcacagaacaccgatagcgaaggcagctcactaggtctggattgacgctcaggaccaaaagcgtgggagcaaacagg

SEQ ID NO: 280 - DNA, 251 bp, Unknown
  Kingdom: Bacteria, Phylum: Bacteroidetes, Class: Flavobacteriia, Order: Flavobacteriales, Family: Flavobacteriaceae, Genus: Flavobacterium
tacggaggatccaagcgttatccggaatcattgggtttaaagggtccgtaggcggttttgtaagtcagtggtgaaatccggcagctcaactgtcgcactgccattgatactgcaggacttgaattattgtgaagtaactagaatatgtagtgtagcggtgaaatgcttagatattacatggaatacccattgcgaaggcaggttactaacaatattgacgctgatggacgaaagcgtggggagcgaacagg

SEQ ID NO: 281 - DNA, 254 bp, Unknown
  Kingdom: Bacteria, Phylum: Bacteroidetes, Class: Flavobacteriia, Order: Flavobacteriales, Family: Flavobacteriaceae, Genus: Flavobacterium
atacggaggatccaagcgttatccggaatcattgggtttaaagggtccgtaggcggtttggtaagtcagtggtgaaagcccatcgctcaacggtggaacggccattgatactgctaaacttgaattattgggaagtaactagaatatgtagtgtagcggtgaaatgcttagagattacatggaataccaattgcgaaggcaggttactaccaatcgattgacgctgatggacgaaagcgtgggtagcgaacagg

SEQ ID NO: 282 - DNA, 254 bp, Unknown
  Kingdom: Bacteria, Phylum: Bacteroidetes, Class: Flavobacteriia, Order: Flavobacteriales, Family: Flavobacteriaceae, Genus:
atacggaggatccaagcgttatccggaatcattgggtttaaagggtccgtaggcggttttataagtcagtggtgaaatctggtcgctcaacgatcaaacggccattgatactgtagaacttgaattacttggaagtaactagaatatgtagtgtagcggtgaaatgcttagagattacatggaataccaattgcgaaggcaggttactacgagttgattgacgctgatggacgaaagcgtggggagcgaacagg

SEQ ID NO: 283 - DNA, 254 bp, Unknown
  Kingdom: Bacteria, Phylum: Bacteroidetes, Class: Flavobacteriia, Order: Flavobacteriales, Family: Flavobacteriaceae, Genus:
atacggaggatccaagcgttatccggaatcattgggtttaaagggtccgtaggcgggtttataagtcagtggtgaaagcccatcgctcaacgatggaacggccattgatactgtagatcttgaattattaggaagtaactagaatatgtagtgtagcggtgaaatgcttagagattacatggaataccaattgcgaaggcaggttactactaatggattgacgctgatggacgaaagcgtgggtagcgaacagg

SEQ ID NO: 284 - DNA, 254 bp, Unknown
  Kingdom: Bacteria, Phylum: Bacteroidetes, Class: Flavobacteriia, Order: Flavobacteriales, Family: Flavobacteriaceae, Genus:
atacggaggatccaagcgttatccggaatcattgggtttaaagggtccgtaggcggtttagtaagtcagtggtgaaagcccatcgctcaacggtggaacggccattgatactgctgaacttgaattattaggaagtaactagaatatgtagtgtagcggtgaaatgcttagatattacatggaataccaattgcgaaggcaggttactactaatggattgacgctgatggacgaaagcgtggggagcgaacagg

SEQ ID NO: 285 - DNA, 254 bp, Unknown
  Kingdom: Bacteria, Phylum: Bacteroidetes, Class: Flavobacteriia, Order: Flavobacteriales, Family: Flavobacteriaceae, Genus:
atacggaggatccaagcgttatccggaatcattgggtttaaagggtccgtaggcggtttagtaagtcagtggtgaaagcccatcgctcaacggtggaacggccattgatactgctagacttgaattattaggaagtaactagaatatgtagtgtagcggtgaaatgcttagagattacatggaataccaattgcgaaggcaggttactactaattgattgacgctgatggacgaaagcgtggggagcgaacagg

SEQ ID NO: 286 - DNA, 254 bp, Unknown
  Kingdom: Bacteria, Phylum: Bacteroidetes, Class: Flavobacteriia, Order: Flavobacteriales, Family: Flavobacteriaceae, Genus:
atacggaggatccaagcgttatccggaatcattgggtttaaagggtccgtaggcggtttggtaagtcagtggtgaaagcccatcgctcaacggtggaacggccattgatactgccagacttgaattattaggaagtaactagaatatgtagtgtagcggtgaaatgcttagagattacatggaataccaattgcgaaggcaggttactactaatggattgacgctgatggacgaaagcgtgggtagcgaacagg

SEQ ID NO: 287 - DNA, 254 bp, Unknown
  Kingdom: Bacteria, Phylum: Bacteroidetes, Class: Flavobacteriia, Order: Flavobacteriales, Family: Flavobacteriaceae, Genus:
atacggagggtgcaagcgttatccggatttattgggtttaaagggtccgtaggcggactcgtaagtcagtggtgaaatctcatagctcaactatgaaactgccattgatactgcgggtcttgagtaaggtagaagtggctggaataagtagtgtagcggtgaaatgcatagatattacttagaacaccaattgcgaaggcaggtcactatgtcttaactgacgctgatggacgaaagcgtggggagcgaacagg

SEQ ID NO: 288 - DNA, 254 bp, Unknown
  Kingdom: Bacteria, Phylum: Bacteroidetes, Class: Flavobacteriia, Order: Flavobacteriales, Family: Flavobacteriaceae, Genus:
atacggaggatccaagcgttatccggaatcattgggtttaaagggtccgtaggcggtttagtaagtcagtggtgaaagcccatcgctcaacggtggaacggccattgatactgctgaacttgaattattaggaagtaactagaatatgtagtgtagcggtgaaatgcttagagattacatggaataccaattgcgaaggcaggttactactaatggattgacgctgatggacgaaagcgtgggtagcgaacagg

SEQ ID NO: 289 - DNA, 251 bp, Unknown
  Kingdom: Bacteria, Phylum: Bacteroidetes, Class: Flavobacteriia, Order: Flavobacteriales, Family: Flavobacteriaceae, Genus:
tacggaggatccaagcgttatccggaatcattgggtttaaagggtccgtaggcggccaggtaagtcagtggtgaaagcccatcgctcaacggtggaacggccattgatactgccaggcttgaatttctgggaagtaactagaatatgtagtgtagcggtgaaatgcttagatattacatggaataccaattgcgaaggcaggttactaccagtattgacgctgatggacgaaagcgtgggtagcgaacagg

SEQ ID NO: 290 - DNA, 254 bp, Unknown
  Kingdom: Bacteria, Phylum: Bacteroidetes, Class: Flavobacteriia, Order: Flavobacteriales, Family: Flavobacteriaceae, Genus:
atacggagggtgcaagcgttatccggatttattgggtttaaagggtccgtaggtgggttagtaagtcagtggtgaaatcctgcagcttaactgtagaactgccattgatactgctagtcttgagtgtatttgaagtagctggaataagtagtgtagcggtgaaatgcatagatattacttagaacaccaattgcgaaggcaggttactaagatacaactgacgctgagggacgaaagcgtggggagcgaacagg

SEQ ID NO: 291 - DNA, 254 bp, Unknown
  Kingdom: Bacteria, Phylum: Bacteroidetes, Class: Flavobacteriia, Order: Flavobacteriales, Family: Flavobacteriaceae, Genus:
atacggagggtgcaagcgttatccggatttattgggtttaaagggtccgtaggcggatctgtaagtcagtggtgaaatctttcggcttaaccggaaaactgccattgatactgcaggtcttgagtaaggtagaagtggctggaataagtagtgtagcggtgaaatgcatagatattacttagaacaccaattgcgaaggcaggtcactatgtcttaactgacgctgatggacgaaagcgtggggagcgaacagg

SEQ ID NO: 292 - DNA, 254 bp, Unknown
  Kingdom: Bacteria, Phylum: Bacteroidetes, Class: Flavobacteriia, Order: Flavobacteriales, Family: Flavobacteriaceae, Genus:
atacggaggatccaagcgttatccggaatcattgggtttaaagggtccgtaggcggtttagtaagtcagtggtgaaagcccatcgctcaacggtggaacggccattgatactgctagacttgaattattaggaagtaactagaatatgtagtgtagcggtgaaatgcttagagattacatggaataccaattgcgaaggcaggttactactaatggattgacgctgatggacgaaagcgtgggtagcgaacagg

SEQ ID NO: 293 - DNA, 254 bp, Unknown
  Kingdom: Bacteria, Phylum: Bacteroidetes, Class: Flavobacteriia, Order: Flavobacteriales, Family: Flavobacteriaceae, Genus:
atacggaggatccaagcgttatccggaatcattgggtttaaagggtctgtaggcggtcttgtaagtcagtggtgaaagcccatcgctcaacggtggaacggccattgatactgctggacttgaattattgggaagcaactagaatatgtagtgtagcggtgaaatgcttagagattacatggaataccaattgcgaaggcaggttgctaccaatggattgacgctgatggacgaaagcgtgggtagcgaacagg

SEQ ID NO: 294 - DNA, 254 bp, Unknown
  Kingdom: Bacteria, Phylum: Bacteroidetes, Class: Flavobacteriia, Order: Flavobacteriales, Family: Flavobacteriaceae, Genus:
atacggaggatccaagcgttatccggaatcattgggtttaaagggtccgtaggcggttttataagtcagtggtgaaatccggcagctcaactgtcgaactgccattgatactgtagaacttgaattattgtgaagtaactagaatatgtagtgtagcggtgaaatgcttagatattacatggaataccaattgcgaaggcaggttactaacaatacattgacgctgatggacgaaagcgtggggagcgaacagg

SEQ ID NO: 295 - DNA, 254 bp, Unknown
  Kingdom: Bacteria, Phylum: Bacteroidetes, Class: Flavobacteriia, Order: Flavobacteriales, Family: Flavobacteriaceae, Genus:
atacggaggatccaagcgttatccggaatcattgggtttaaagggtccgtaggcggtttaataagtcagtggtgaaagcccatcgctcaacggtggaacggccattgatactgttaaacttgaattattaggaagtaactagaatatgtagtgtagcggtgaaatgcttagagattacatggaataccaattgcgaaggcaggttactactaatggattgacgctgatggacgaaagcgtgggtagcgaacagg

SEQ ID NO: 296 - DNA, 254 bp, Unknown
  Kingdom: Bacteria, Phylum: Bacteroidetes, Class: Flavobacteriia, Order: Flavobacteriales, Family: Flavobacteriaceae, Genus:
atacggagggtgcaagcgttatccggatttattgggtttaaagggtccgtaggcggatctgtaagtcagtggtgaaatctcacagcttaactgtgaaactgccattgatactgcaggtcttgagtgttgttgaagtagctggaataagtagtgtagcggtgaaatgcatagatattacttagaacaccaattgcgaaggcaggttactaagcaacaactgacgctgatggacgaaagcgtggggagcgaacagg

SEQ ID NO: 297 - DNA, 254 bp, Unknown
  Kingdom: Bacteria, Phylum: Bacteroidetes, Class: Flavobacteriia, Order: Flavobacteriales, Family: Flavobacteriaceae, Genus:
atacggagggtgcaagcgttatccggatttattgggtttaaagggtccgtaggcggatctgtaagtcagtggtgaaatctcatagcttaactatgaaactgccattgatactgcaggtcttgagtaaagtagaagtggctggaataagtagtgtagcggtgaaatgcatagatattacttagaacaccaattgcgaaggcaggtcactatgttttaactgacgctgatggacgaaagcgtggggagcgaacagg

SEQ ID NO: 298 - DNA, 254 bp, Unknown
  Kingdom: Bacteria, Phylum: Bacteroidetes, Class: Flavobacteriia, Order: Flavobacteriales, Family: Flavobacteriaceae, Genus:
atacggaggatccaagcgttatccggaatcattgggtttaaagggtccgtaggcggttttataagtcagtggtgaaatccggtagctcaactatcgaactgccattgatactgtagaacttgaattattgtgaagtaactagaatatgtagtgtagcggtgaaatgcttagatattacatggaataccaattgcgaaggcaggttactaacaatacattgacgctgatggacgaaagcgtggggagcgaacagg

SEQ ID NO: 299 - DNA, 254 bp, Unknown
  Kingdom: Bacteria, Phylum: Bacteroidetes, Class: Flavobacteriia, Order: Flavobacteriales, Family: Flavobacteriaceae, Genus:
atacggagggtgcaagcgttatccggatttattgggtttaaagggtccgtaggcggatctgtaagtcagtggtgaaatctcacagcttaactgtgaaactgccattgatactgcaggtcttgagtaaggtagaagtggctggaataagtagtgtagcggtgaaatgcatagatattacttagaacaccaattgcgaaggcaggtcactatgtcttaactgacgctgatggacgaaagcgtggggagcgaacagg

SEQ ID NO: 300 - DNA, 254 bp, Unknown
  Kingdom: Bacteria, Phylum: Bacteroidetes, Class: Flavobacteriia, Order: Flavobacteriales, Family: Flavobacteriaceae, Genus:
atacggaggatccaagcgttatccggaatcattgggtttaaagggtccgtaggcggttttataagtcagtggtgaaatccggcagctcaactgtcgaactgccattgatactgtaggacttgaattattgtgaagtaactagaatatgtagtgtagcggtgaaatgcttagatattacatggaatacccattgcgaaggcaggttactaacaatatattgacgctgatggacgaaagcgtggggagcgaacagg

SEQ ID NO: 301 - DNA, 254 bp, Unknown
  Kingdom: Bacteria, Phylum: Bacteroidetes, Class: Flavobacteriia, Order: Flavobacteriales, Family: Flavobacteriaceae, Genus:
atacggaggatccaagcgttatccggaatcattgggtttaaagggtccgtaggcggtttggtaagtcagtggtgaaagcccatcgctcaacggtggaacggccattgatactgccagacttgaattattaggaagtaactagaatatgtagtgtagcggtgaaatgcttagagattacatggaataccaattgcgaaggcaggttactactaattgattgacgctgatggacgaaagcgtgggtagcgaacagg

SEQ ID NO: 302 - DNA, 254 bp, Unknown
  Kingdom: Bacteria, Phylum: Bacteroidetes, Class: Flavobacteriia, Order: Flavobacteriales, Family: Flavobacteriaceae, Genus:
atacggaggatccaagcgttatccggaatcattgggtttaaagggtccgtaggcggttttataagtcagtggtgaaatctggtcgctcaacgatcaaacggccattgatactgtagaacttgaattacttggaagtaactagaatatgtagtgtagcggtgaaatgcttagagattacatggaataccaattgcgaaggcaggttgctacgagtacattgacgctgatggacgaaagcgtggggagcgaacagg

SEQ ID NO: 303 - DNA, 254 bp, Unknown
  Kingdom: Bacteria, Phylum: Bacteroidetes, Class: Flavobacteriia, Order: Flavobacteriales, Family: Flavobacteriaceae, Genus:
atacggaggatccaagcgttatccggaatcattgggtttaaagggtccgtaggcggtcttataagtcagtggtgaaatctccccgctcaacggggaaacggccattgatactgtaggacttgaattattaggaagtaactagaatatgtagtgtagcggtgaaatgcttagagattacatggaataccaattgcgaaggcaggttactactaatggattgacgctgatggacgaaagcgtgggtagcgaacagg

SEQ ID NO: 304 - DNA, 254 bp, Unknown
  Kingdom: Bacteria, Phylum: Bacteroidetes, Class: Flavobacteriia, Order: Flavobacteriales, Family: Flavobacteriaceae, Genus:
atacggaggatccaagcgttatccggaatcattgggtttaaagggtccgtaggcggtttagtaagtcagtggtgaaagcccatcgctcaacggtggaacggccattgatactgctaaacttgaattattaggaagtaactagaatatgtagtgtagcggtgaaatgcttagagattacatggaataccaattgcgaaggcaggttactactaatggattgacgctgatggacgaaagcgtgggtagcgaacagg

SEQ ID NO: 305 - DNA, 254 bp, Unknown
  Kingdom: Bacteria, Phylum: Bacteroidetes, Class: Flavobacteriia, Order: Flavobacteriales, Family: Flavobacteriaceae, Genus:
atacggagggtgcaagcgttatccggatttattgggtttaaagggtccgtaggcggactcgtaagtcagtggtgaaatctcatagcttaactatgaaactgccattgatactgcgggtcttgagtaaggtagaggtagctggaataagtagtgtagcggtgaaatgcatagatattacttagaacaccaattgcgaaggcaggttaccatgtcttaactgacgctgatggacgaaagcgtggggagcgaacagg

SEQ ID NO: 306 - DNA, 254 bp, Unknown
  Kingdom: Bacteria, Phylum: Bacteroidetes, Class: Flavobacteriia, Order: Flavobacteriales, Family: Flavobacteriaceae, Genus:
atacggagggtgcaagcgttatccggatttattgggtttaaagggtccgtaggcggatctgtaagtcagtggtgaaatctcatagcttaactatgaaactgccattgatactgcaggtcttgagtgagattgaggtagctggaataagtagtgtagcggtgaaatgcatagatattacttagaacaccaattgcgaaggcaggttaccaagtcttaactgacgctgatggacgaaagcgtggggagcgaacagg

SEQ ID NO: 307 - DNA, 254 bp, Unknown
  Kingdom: Bacteria, Phylum: Bacteroidetes, Class: Flavobacteriia, Order: Flavobacteriales, Family: Flavobacteriaceae, Genus:
atacggaggatccaagcgttatccggaatcattgggtttaaagggtccgtaggcggccttataagtcagtggtgaaatcccgcagctcaactgtggaatggccattgatactgtagggcttgaattatagtgaagtaactagaatatgtagtgtagcggtgaaatgcttagatattacatggaatacccattgcgaaggcaggttactaactatggattgacgctgatggacgaaagcgtggggagcgaacagg

SEQ ID NO: 308 - DNA, 254 bp, Unknown
  Kingdom: Bacteria, Phylum: Bacteroidetes, Class: Flavobacteriia, Order: Flavobacteriales, Family: Flavobacteriaceae, Genus:
atacggagggtgcaagcgttatccggatttattgggtttaaagggtccgtaggcggactcgtaagtcagtggtgaaatctcatagcttaactatgaaactgccattgatactgcgggtcttgagtaaagtagaagtggctggaataagtagtgtagcggtgaaatgcatagatattacttagaacaccaattgcgaaggcaggtcactatgttttaactgacgctgatggacgaaagcgtggggagcgaacagg

SEQ ID NO: 309 - DNA, 251 bp, Unknown
  Kingdom: Bacteria, Phylum: Bacteroidetes, Class: Flavobacteriia, Order: Flavobacteriales, Family: Weeksellaceae, Genus:
tacggagggtgcaagcgttatccggatttattgggtttaaagggtccgtaggcggatcagtaagtcagtggtgaaatctcatagctcaactatgaaactgccattgatactgctggtcttgagtaaggtagaagtagctggaataagtagtgtagcggtgaaatgcatagatattacttagaacaccaattgcgaaggcaggttactatgtctactgacgctgatggacgaaagcgtggggagcgaacagg

SEQ ID NO: 310 - DNA, 251 bp, Unknown
  Kingdom: Bacteria, Phylum: Bacteroidetes, Class: Flavobacteriia, Order: Flavobacteriales, Family: Weeksellaceae, Genus:
tacggagggtgcaagcgttatccggatttattgggtttaaagggtccgtaggcggatctgtaagtcagtggtgaaatctcacagcttaactgtgaaactgccattgatactgcaggtcttgagtaaggtagaagtggctggaataagtagtgtagcggtgaaatgcatagatattacttagaacaccaattgcgaaggcaggtcactatgtctactgacgctgatggacgaaagcgtggggagcgaacagg

SEQ ID NO: 311 - DNA, 251 bp, Unknown
  Kingdom: Bacteria, Phylum: Bacteroidetes, Class: Saprospirae, Order: Saprospirales, Family: Chitinophagaceae, Genus:
tacggagggtgcaagcgttatccggatttactgggtttaaagggtgtgtaggcgggcatttaagtctggggtgaaatctccgagctcaactcggaaactgccttggatactatttgtcttgaattatgttgaggttggcggaatataacatgtagcggtgaaatgcatagatatgttatagaacaccgattgcgaaggcagctaactaagcatattgacgctgaggcacgaaagcgtggggatcaaacagg

SEQ ID NO: 312 - DNA, 251 bp, Unknown
  Kingdom: Bacteria, Phylum: Bacteroidetes, Class: Saprospirae, Order: Saprospirales, Family: Chitinophagaceae, Genus:
tacggagggtgcaagcgttatccggattcactgggtttaaagggtgcgtaggcgggcaggtaagtcagaggtgaaatctccgagcttaactcggaaactgcctttgatactatctgtcttgaatatggtggaggtaagcggaatatgtcatgtagcggtgaaatgcttagagatgacatagaacacccattgcgaaggcagcttactacgcctattgacgctgaggcacgaaagcgtggggatcaaacagg

SEQ ID NO: 313 - DNA, 251 bp, Unknown
  Kingdom: Bacteria, Phylum: Bacteroidetes, Class: Saprospirae, Order: Saprospirales, Family: Chitinophagaceae, Genus:
tacggagggtgcaagcgttatccggattcactgggtttaaagggagcgtaggtgggctggtaagtcagtggtgaaatctccgggcttaactcggaaactgccgttgatactatcagtcttgaatattgtggaggtaagcggaatatgtcatgtagcggtgaaatgcttagatatgacatagaacaccgatagcgaaggcagcttgctacacaaattgacactgaggctcgaaagcgtggggatcaaacagg

SEQ ID NO: 314 - DNA, 251 bp, Unknown
  Kingdom: Bacteria, Phylum: Bacteroidetes, Class: Saprospirae, Order: Saprospirales, Family: Chitinophagaceae, Genus:
tacggagggtgcaagcgttatccggatttactgggtttaaagggtgcgcaggcggatacgtaagtcagtggtgaaatctccgggcttaacctggaaattgccgttgatactatatatcttgaatgttgtggaggtaagcagaatatgtcatgtagcggtgaaatgcttagagatgacatagaatacctattgcgaaggcagcttactacgcagattgacgctcatgcacgaaagcgtggggatcaaacagg

SEQ ID NO: 315 - DNA, 251 bp, Unknown
  Kingdom: Bacteria, Phylum: Bacteroidetes, Class: Saprospirae, Order: Saprospirales, Family: Chitinophagaceae, Genus:
tacggagggtgcaagcgttatccggattcactgggtttaaagggtgcgtaggagggcagggaagtcagtggtgaaatctccgggcttaactcggaaactgccgttgatactctctgtcttgaatcccgtggaggtgagcggaatatgtcatgtagcggtgaaatgcttagatatgacatagaacaccaattgcgaaggcagctcgctacacgaattgactctgaggcacgaaagcgtggggatcaaacagg

SEQ ID NO: 316 - DNA, 251 bp, Unknown
  Kingdom: Bacteria, Phylum: Bacteroidetes, Class: Saprospirae, Order: Saprospirales, Family: Chitinophagaceae, Genus:
tacggagggtgcaagcgttatccggattcactgggtttaaagggtgcgtaggagggcaggtaagtcagtggtgaaatctccaagcttaacttggaaactgccgttgatactatctgtcttgaataccgtggagatgagcggaatatgtcatgtagcggtgaaatgcttagatatgacatagaacaccaattgcgaaggcagctcgttacacgaattgactctgaggcacgaaagcgtggggatcaaacagg

SEQ ID NO: 317 - DNA, 251 bp, Unknown
  Kingdom: Bacteria, Phylum: Bacteroidetes, Class: Saprospirae, Order: Saprospirales, Family: Chitinophagaceae, Genus:
tacggagggtgcaagcgttatccggattcactgggtttaaagggtgcgtaggcggattagtaagtccgtggtgaaatctccaagcttaacttggaaactgccatggatactattagtcttgaatgttgtggaggttagcggaatatgtcatgtagcggtgaaatgcatagatatgacatagaacaccaattgcgaaggcagctggctacacaaattgacgctgaggcacgaaagcgtggggatcaaacagg

SEQ ID NO: 318 - DNA, 251 bp, Unknown
  Kingdom: Bacteria, Phylum: Bacteroidetes, Class: Saprospirae, Order: Saprospirales, Family: Chitinophagaceae, Genus:
tacggagggtgcaagcgttatccggattcactgggtttaaagggtgcgtaggagggcaggtaagtcagtggtgaaatctccgagcttaactcggaaactgccgttgatactatctgtcttgaataccgtggaggtgagcggaatatgtcatgtagcggtgaaatgcttagatatgacatagaacaccaattgcgaaggcagctcactacacgaattgactctgaggcacgaaagcgtggggatcaaacagg

SEQ ID NO: 319 - DNA, 251 bp, Unknown
  Kingdom: Bacteria, Phylum: Bacteroidetes, Class: Saprospirae, Order: Saprospirales, Family: Chitinophagaceae, Genus:
tacggagggtgcaagcgttatccggattcactgggtttaaagggtgcgtaggcggatttgtaagtccgtggtgaaatctccaggcttaacctggaaactgccatggatactataagtcttgaatattgtggaggttagcggaatatgtcatgtagcggtgaaatgcatagatatgacatagaacaccaattgcgaaggcagctggctacacaaattgacgctgaggcacgaaagcgtggggatcaaacagg

SEQ ID NO: 320 - DNA, 251 bp, Unknown
  Kingdom: Bacteria, Phylum: Bacteroidetes, Class: Saprospirae, Order: Saprospirales, Family: Chitinophagaceae, Genus:
tacggagggtgcaagcgttatccggattcactgggtttaaagggtgcgtaggcggattagaaagtccgttgtgaaatctctgagcttaactcggaaattgcggtggatactattagtcttgaatactgtggaggttagcggaatatgtcatgtagcggtgaaatgcatagatatgacatagaacaccaattgcgaaagcagctggctacacagattgacgctgaggcacgaaagcgtggggatcaaacagg

SEQ ID NO: 321 - DNA, 251 bp, Unknown
  Kingdom: Bacteria, Phylum: Bacteroidetes, Class: Saprospirae, Order: Saprospirales, Family: Chitinophagaceae, Genus:
tacggagggtgcaagcgttatccggatttactgggtttaaagggtgcgtaggtgggttggtaagtcagtggtgaaatcttcgagcttaactcggaaactgccattgatactatcaatcttgaattatctggaggtaagcggaatatgtcatgtagcggtgaaatgcttagatatgacatagaacacccattgcgaaggcagcttactacggatattgacactgaggcacgaaagcgtggggatcaaacagg

SEQ ID NO: 322 - DNA, 251 bp, Unknown
  Kingdom: Bacteria, Phylum: Bacteroidetes, Class: Saprospirae, Order: Saprospirales, Family: Chitinophagaceae, Genus:
tacggagggtgcaagcgttatccggattcactgggtttaaagggagcgtaggtgggcttgtaagtcagtggtgaaatctctgggcttaacccggaaactgccattgatactataggtcttgaattctctggaggtaagcggaatatgtcatgtagcggtgaaatgcttagatatgacatagaacacccattgcgaaggcagcttactacggagattgacactgaggctcgaaagcgtggggatcaaacagg

SEQ ID NO: 323 - DNA, 254 bp, Unknown
  Kingdom: Bacteria, Phylum: Bacteroidetes, Class: Sphingobacteriia, Order: Sphingobacteriales, Family: AKYH767, Genus:
atacgaaggtcccaagcgttatccggatttattgggtttaaagggtgcgtaggcgggttattaagtcagtggtgaaagccttcagcttaactgaagaactgccattgatactgatgatcttgagtatgattgaggtgggcggaatgtgtcatgtagcggtgaaatgcttagatatgacacagaacaccgattgcgaaggcagctcactaagccataactgacgctgatgcacgaaagcgtggggagcaaacagg

SEQ ID NO: 324 - DNA, 254 bp, Unknown
  Kingdom: Bacteria, Phylum: Bacteroidetes, Class: Sphingobacteriia, Order: Sphingobacteriales, Family: AKYH767, Genus:
atacgaaggtcccaagcgttatccggatttattgggtttaaagggtgcgtaggcgggctattaagtcagtggtgaaagccccaagcttaacttgggaactgccattgatactgatggtcttgagtacatttgaggtgggcggaatgtgtcatgtagcggtgaaatgcttagatatgacacagaacaccgattgcgaaggcagctcactaaactgtaactgacgctgaggcacgaaagcgtggggagcaaacagg

SEQ ID NO: 325 - DNA, 254 bp, Unknown
  Kingdom: Bacteria, Phylum: Bacteroidetes, Class: Sphingobacteriia, Order: Sphingobacteriales, Family: Chitinophagaceae, Genus: Ferruginibacter
atacggagggtgcaagcgttatccggattcactgggtttaaagggtgcgtaggtgggcgagtaagtccgtggtgaaatcctgcagcttaactgcagaactgccatggatactatttgtcttgaataccgtggaggtcagcggaatatgtcatgtagcggtgaaatgcttagatatgacatagaacacccattgcgaaggcagctgactacgcgaatattgacactcaggcacgaaagcgtggggatcaaacagg

SEQ ID NO: 326 - DNA, 254 bp, Unknown
  Kingdom: Bacteria, Phylum: Bacteroidetes, Class: Sphingobacteriia, Order: Sphingobacteriales, Family: Chitinophagaceae, Genus: Flavisolibacter
atacggagggtgcaagcgttatccggattcactgggtttaaagggagcgtaggagggcaggtaagtcagtggtgaaatcttcgagcttaactcggaaactgccgttgatactatctgtcttgaataccgtggagatgagcggaatatgtcatgtagcggtgaaatgcttagatatgacatagaacaccaattgcgaaggcagctcgttacacgaatattgactctgaggctcgaaagcgtggggatcaaacagg

SEQ ID NO: 327 - DNA, 254 bp, Unknown
  Kingdom: Bacteria, Phylum: Bacteroidetes, Class: Sphingobacteriia, Order: Sphingobacteriales, Family: Chitinophagaceae, Genus: Terrimonas
atacggagggtgcaagcgttatccggattcactgggtttaaagggtgcgtaggtgggttggtaagtcagtggtgaaatccccgagcttaacttgggaactgccattgatactatcagtcttgaatatcgtggaggttagcggaatatgtcatgtagcggtgaaatgcttagatatgacatagaacaccaattgcgaaggcagctggctacacgaatattgacactgaggcacgaaagcgtggggatcaaacagg

SEQ ID NO: 328 - DNA, 254 bp, Unknown
  Kingdom: Bacteria, Phylum: Bacteroidetes, Class: Sphingobacteriia, Order: Sphingobacteriales, Family: Chitinophagaceae, Genus:
atacggagggtgcaagcgttatccggattcactgggtttaaagggtgcgtaggtgggttggtaagtcagtggtgaaatccccgagcttaacttgggaactgccattgatactatcagtcttgaatattgtggaggttagcggaatatgtcatgtagcggtgaaatgcttagatatgacatagaacaccaattgcgaaggcagctggctacgcatatattgacactgaggcacgaaagcgtggggatcaaacagg

SEQ ID NO: 329 - DNA, 254 bp, Unknown
  Kingdom: Bacteria, Phylum: Bacteroidetes, Class: Sphingobacteriia, Order: Sphingobacteriales, Family: Chitinophagaceae, Genus:
atacggagggtgcaagcgttatccggattcactgggtttaaagggtgcgtaggcggattagtaagtccgtggtgaaatctccgagcttaactcggaaactgccgtggatactattaatcttgaatactgtggaggttagcggaatatgtcatgtagcggtgaaatgcatagatatgacatagaacaccaattgcgaaggcagctggctacacagagattgacgctgaggcacgaaagcgtggggatcaaacagg

SEQ ID NO: 330 - DNA, 254 bp, Unknown
  Kingdom: Bacteria, Phylum: Bacteroidetes, Class: Sphingobacteriia, Order: Sphingobacteriales, Family: Chitinophagaceae, Genus:
atacggagggtgcaagcgttatccggattcactgggtttaaagggtgcgtaggagggcaggtaagtcagtggtgaaatctccgagcttaacttggaaactgccgttgatactatctgtcttgaatattgtggaggtgagcggaatatgtcatgtagcggtgaaatgcttagatatgacatagaacaccaattgcgaaggcagctcgctacacaaatattgactctgaggcacgaaagcgtggggatcaaacagg

SEQ ID NO: 331 - DNA, 254 bp, Unknown
  Kingdom: Bacteria, Phylum: Bacteroidetes, Class: Sphingobacteriia, Order: Sphingobacteriales, Family: Chitinophagaceae, Genus:
atacggagggtgcaagcgttatccggatttactgggtttaaagggtgcgtaggtgggtaggtaagtcagtggtgaaatcttcaagcttaacttggaaactgccattgatactatttatcttgaatactttggaggtaagcggaatatgtcatgtagcggtgaaatgcttagatatgacatagaacaccaattgcgaaggcagcttactacacagttattgacactgaggcacgaaagcgtggggatcaaacagg

SEQ ID NO: 332 - DNA, 254 bp, Unknown
  Kingdom: Bacteria, Phylum: Bacteroidetes, Class: Sphingobacteriia, Order: Sphingobacteriales, Family: Chitinophagaceae, Genus:
atacggagggtgcaagcgttatccggattcactgggtttaaagggagcgtaggtgggctggtaagtcagtggtgaaatctccgggcttaactcggaaactgccgttgatactatcagtcttgaatgttgtggaggtaagcggaatatgtcatgtagcggtgaaatgcttagatatgacatagaacaccgatagcgaaggcagcttgctacacaattattgacactgaggctcgaaagcgtggggatcaaacagg

SEQ ID NO: 333 - DNA, 254 bp, Unknown
  Kingdom: Bacteria, Phylum: Bacteroidetes, Class: Sphingobacteriia, Order: Sphingobacteriales, Family: Chitinophagaceae, Genus:
atacggagggtgcaagcgttatccggattcactgggtttaaagggtgcgtaggtgggtctgtaagtcagtggtgaaatctccgagcttaacttggaaactgccattgatactatagatcttgaatattgtggaggtcagcggaatatgtcatgtagcggtgaaatgcttagagatgacatagaacaccaattgcgaaggcagctggctacacatatattgacactgaggcacgaaagcgtggggatcaaacagg

SEQ ID NO: 334 - DNA, 254 bp, Unknown
  Kingdom: Bacteria, Phylum: Bacteroidetes, Class: Sphingobacteriia, Order: Sphingobacteriales, Family: Chitinophagaceae, Genus:
atacggagggtgcaagcgttatccggattcactgggtttaaagggtgcgtaggagggcaggtaagtcagtggtgaaatctccaagcttaacttggaaactgccgttgatactatctgtcttgaataccgtggaggtgagcggaatatgtcatgtagcggtgaaatgcttagatatgacatagaacaccaattgcgaaggcagctcgctacacgaatattgactctgaggcacgaaagcgtggggatcaaacagg

SEQ ID NO: 335 - DNA, 254 bp, Unknown
  Kingdom: Bacteria, Phylum: Bacteroidetes, Class: Sphingobacteriia, Order: Sphingobacteriales, Family: Chitinophagaceae, Genus:
atacggagggtgcaagcgttatccggattcactgggtttaaagggtgcgtaggcggattagtaagtccgtggtgaaatctccaagcttaacttggaaactgccatggatactattagtcttgaatgttgtggaggttagcggaatatgtcatgtagcggtgaaatgcatagatatgacatagaacaccaattgcgaaggcagctggctacacaaatattgacgctgaggcacgaaagcgtggggatcaaacagg

SEQ ID NO: 336 - DNA, 254 bp, Unknown
  Kingdom: Bacteria, Phylum: Bacteroidetes, Class: Sphingobacteriia, Order: Sphingobacteriales, Family: Chitinophagaceae, Genus:
atacggagggtgcaagcgttatccggattcactgggtttaaagggtgcgtaggcgggttggtaagtccgtggtgaaatctccaagcttaacttggaaactgccgtggatactatcaatcttgaatatagtggaggtgagcggaatatgtcatgtagcggtgaaatgcttagatatgacatagaacacctattgcgaaggcagctcgctacactattattgacgctgaggcacgaaagcgtggggatcaaacagg

SEQ ID NO: 337 - DNA, 254 bp, Unknown
  Kingdom: Bacteria, Phylum: Bacteroidetes, Class: Sphingobacteriia, Order: Sphingobacteriales, Family: Chitinophagaceae, Genus:
atacggagggtgcaagcgttatccggattcactgggtttaaagggtgcgtaggtgggatggtaagtcagtggtgaaatctccgggcttaactcggaaactgccgttgatactatcattcttgaatattgtggaggtaagcggaatatgtcatgtagcggtgaaatgcttagatatgacatagaacaccgatagcgaaggcagcttgctacacaattattgacactgaggcacgaatgcgtggggatcaaacagg

SEQ ID NO: 338 - DNA, 254 bp, Unknown
  Kingdom: Bacteria, Phylum: Bacteroidetes, Class: Sphingobacteriia, Order: Sphingobacteriales, Family: Chitinophagaceae, Genus:
atacggagggtgcaagcgttatccggattcactgggtttaaagggtgcgtaggtgggttgccaagtccgtggtgaaatctccgagcttaactcggaaactgccgtggatactggtaatcttgaatatcgtggaggtaagcggaatatgtcatgtagcggtgaaatgcttagatatgacatagaacaccgatagcggaggcagcttgctacacgatcattgacactgaggcacgaaagcgtggggagcaaacagg

SEQ ID NO: 339 - DNA, 254 bp, Unknown
  Kingdom: Bacteria, Phylum: Bacteroidetes, Class: Sphingobacteriia, Order: Sphingobacteriales, Family: Chitinophagaceae, Genus:
atacggagggtgcaagcgttatccggattcactgggtttaaagggtgcgtaggtgggttggtaagtccgtggtgaaatctccgagcttaactcggaaactgccgtggatactatcaatcttgaatatcgtggaggtaagcggaatatgtcatgtagcggtgaaatgcttagatatgacatagaacaccgatagcggaggcagcttgctacacgatcattgacactgaggcacgaaagcgtggggagcaaacagg

SEQ ID NO: 340 - DNA, 254 bp, Unknown
  Kingdom: Bacteria, Phylum: Bacteroidetes, Class: Sphingobacteriia, Order: Sphingobacteriales, Family: Chitinophagaceae, Genus:
atacggagggtgcaagcgttatccggattcactgggtttaaagggtgcgtaggtgggcaggtaagtcagtggtgaaatctccgggcttaacccggaaactgccgttgatactatctgtcttgaatgtagtggaggtgagcggaatatgtcatgtagcggtgaaatgcttagatatgacatagaacacccattgcgaaggcagctcgctacactattattgacactgaggcacgaaagcgtggggatcaaacagg

SEQ ID NO: 341 - DNA, 254 bp, Unknown
  Kingdom: Bacteria, Phylum: Bacteroidetes, Class: Sphingobacteriia, Order: Sphingobacteriales, Family: Chitinophagaceae, Genus:
atacggagggtgcaagcgttatccggattcactgggtttaaagggtgcgtaggtgggcaggtaagtcagtggtgaaatctctgggcttaacccagaaactgccgttgatactatctgtcttgaatatagtggaggtgagcggaatatgtcatgtagcggtgaaatgcttagatatgacatagaacacccattgcgaaggcagctcgctacactattattgacactgaggcacgaaagcgtggggatcaaacagg

SEQ ID NO: 342 - DNA, 254 bp, Unknown
  Kingdom: Bacteria, Phylum: Bacteroidetes, Class: Sphingobacteriia, Order: Sphingobacteriales, Family: Chitinophagaceae, Genus:
atacggagggtgcaagcgttatccggattcactgggtttaaagggtgcgtaggtgggttggtaagtcagtggtgaaatccccgagcttaacttgggaactgccattgatactatcagtcttgaataccgtggaggttagcggaatatgtcatgtagcggtgaaatgcttagatatgacatagaacaccaattgcgaaggcagctggctacacgaatattgacactgaggcacgaaagcgtggggatcaaacagg

SEQ ID NO: 343 - DNA, 254 bp, Unknown
  Kingdom: Bacteria, Phylum: Bacteroidetes, Class: Sphingobacteriia, Order: Sphingobacteriales, Family: Chitinophagaceae, Genus:
atacggagggtgcaagcgttatccggattcactgggtttaaagggtgcgtaggcgggcaggtaagtccgtggtgaaatctctgagcttaactcagaaactgccatggatactatttgtcttgaatattgtggaggtaagcggaatatgtcatgtagcggtgaaatgcttagatatgacatagaacaccaattgcgaaggcagcttactacacagttattgacgctgaggcacgaaagcgtggggatcaaacagg

SEQ ID NO: 344 - DNA, 254 bp, Unknown
  Kingdom: Bacteria, Phylum: Bacteroidetes, Class: Sphingobacteriia, Order: Sphingobacteriales, Family: Chitinophagaceae, Genus:
atacggagggtgcaagcgttatccggattcactgggtttaaagggagcgcaggcggatttgtaagtcagtggcgaaaggcttaagcttaacttgggaactgccattgatactataagtcttgaatgttgttgaggtttgcggaatgggtcatgtagcggtgaaatgcatagatatgacccggaacacctattgcgaaggcagcaggctaaacaaatattgacgctgaggctcgaaagcgtggggatcaaacagg

SEQ ID NO: 345 - DNA, 254 bp, Unknown
  Kingdom: Bacteria, Phylum: Bacteroidetes, Class: Sphingobacteriia, Order: Sphingobacteriales, Family: Chitinophagaceae, Genus:
atacggagggtgcaagcgttatccggattcactgggtttaaagggtgcgtaggtgggttggtaagtccgtggtgaaatctccgagcttaactcggaaactgccgtggatactatcaatcttgaatactgtggaggtaagcggaatatgtcatgtagcggtgaaatgcttagatatgacatagaacaccgatagcggaggcagcttgctacacagtcattgacactgaggcacgaaagcgtggggatcaaacagg

SEQ ID NO: 346 - DNA, 254 bp, Unknown
  Kingdom: Bacteria, Phylum: Bacteroidetes, Class: Sphingobacteriia, Order: Sphingobacteriales, Family: Chitinophagaceae, Genus:
atacggagggtgcaagcgttatccggattcactgggtttaaagggagcgtaggtgggcttttaagtcagtggtgaaatctttgggcttaacccgaaaactgccattgatactattagtcttgaattctctggaggtaagcggaatatgtcatgtagcggtgaaatgcttagatatgacatagaacacccattgcgaaggcagcttactacggagacattgacactgaggctcgaaagcgtggggatcaaacagg

SEQ ID NO: 347 - DNA, 254 bp, Unknown
  Kingdom: Bacteria, Phylum: Bacteroidetes, Class: Sphingobacteriia, Order: Sphingobacteriales, Family: Chitinophagaceae, Genus:
atacggagggtgcaagcgttatccggattcactgggtttaaagggtgtgtaggcggatatttaagtcagtggtgaaatctccaggctcaacctggaaactgccattgatactatttatcttgaattctgttgaggtgggcggaatacatcatgtagcggtgaaatgcttagatatgatgtagaacaccgattgcgaaggcagctcactaagcagacattgacgctgaggcacgaaagcgtggggatcaaacagg

SEQ ID NO: 348 - DNA, 254 bp, Unknown
  Kingdom: Bacteria, Phylum: Bacteroidetes, Class: Sphingobacteriia, Order: Sphingobacteriales, Family: Chitinophagaceae, Genus:
atacggagggtgcaagcgttatccggattcactgggtttaaagggtgcgtaggtgggttggtaagtcagtggtgaaatctccgggcttaactcggaaactgccgttgatactatcaatcttgaatctcgtggaggtaagcggaatatgtcatgtagcggtgaaatgcttagatatgacatagaacaccgatagcgaaggcagcttgctacacgagtattgacactgaggcacgaaagcgtggggatcaaacagg

SEQ ID NO: 349 - DNA, 254 bp, Unknown
  Kingdom: Bacteria, Phylum: Bacteroidetes, Class: Sphingobacteriia, Order: Sphingobacteriales, Family: Chitinophagaceae, Genus:
atacggagggtgcaagcgttatccggattcactgggtttaaagggtgcgtaggcgggcatttaagtcagtggtgaaatacctgagcttaacttgggaactgccattgatactatttgtcttgaatgtcgtggaggttagcggaatatgtcatgtagcggtgaaatgcttagatatgacatagaacacctattgcgaaggcagctaactacgcgaatattgacgctgaggcacgaaagcgtggggatcaaacagg

SEQ ID NO: 350 - DNA, 254 bp, Unknown
  Kingdom: Bacteria, Phylum: Bacteroidetes, Class: Sphingobacteriia, Order: Sphingobacteriales, Family: Chitinophagaceae, Genus:
atacggagggtgcaagcgttatccggattcactgggtttaaagggtgtgtaggcggatatttaagtcagtggtgaaatctccgggctcaacccggaaactgccattgatactatttatcttgaatactgttgaggtaggcggaatatatcatgtagcggtgaaatgcttagatatgatatagaacaccgattgcgaaggcagcttactaagcagttattgacgctgaggcacgaaagcgtggggatcaaacagg

SEQ ID NO: 351 - DNA, 254 bp, Unknown
  Kingdom: Bacteria, Phylum: Bacteroidetes, Class: Sphingobacteriia, Order: Sphingobacteriales, Family: Chitinophagaceae, Genus:
atacggagggtgcaagcgttatccggattcactgggtttaaagggtgcgtaggtgggttggtaagtcagtggtgaaatccccgagcttaacttgggaactgccattgatactatcaatcttgaataccgtggaggtcagcggaatatgtcatgtagcggtgaaatgcttagatatgacatagaacaccaattgcgaaggcagctggctacacgaatattgacactgaggcacgaaagcgtggggatcaaacagg

SEQ ID NO: 352 - DNA, 254 bp, Unknown
  Kingdom: Bacteria, Phylum: Bacteroidetes, Class: Sphingobacteriia, Order: Sphingobacteriales, Family: Chitinophagaceae, Genus:
atacggagggtgcaagcgttatccggatttactgggtttaaagggtgtgtaggcgggcttttaagtctggggtgaaatctccgagctcaactcggaaactgccttggatactattagtcttgaattatgttgaggttggcggaatataacatgtagcggtgaaatgcatagatatgttatagaacaccgattgcgaaggcagctaactaagcatatattgacgctgaggcacgaaagcgtggggatcaagcagg

SEQ ID NO: 353 - DNA, 254 bp, Unknown
  Kingdom: Bacteria, Phylum: Bacteroidetes, Class: Sphingobacteriia, Order: Sphingobacteriales, Family: Chitinophagaceae, Genus:
atacggagggtgcaagcgttatccggattcactgggtttaaagggtgcgtaggagggtaggtaagtcagtggtgaaatcttcgagcttaactcggaaactgccgttgatactatctatcttgaataccgtggaggtgagcggaatatgtcatgtagcggtgaaatgcttagatatgacatagaacaccaattgcgaaggcagctcgctacacgaatattgactctgaggcacgaaagcgtggggatcaaacagg

SEQ ID NO: 354 - DNA, 254 bp, Unknown
  Kingdom: Bacteria, Phylum: Bacteroidetes, Class: Sphingobacteriia, Order: Sphingobacteriales, Family: Chitinophagaceae, Genus:
atacggagggtgcaagcgttatccggattcactgggtttaaagggtgcgtaggtgggttggtaagtcagtggtgaaatctccgagcttaacttggaaactgccattgatactatcagtcttgaatattgtggaggttagcggaatatgtcatgtagcggtgaaatgcttagatatgacatagaacaccaattgcgaaggcagctggctacacatatattgacactgaggcacgaaagcgtggggatcaaacagg

SEQ ID NO: 355 - DNA, 254 bp, Unknown
  Kingdom: Bacteria, Phylum: Bacteroidetes, Class: Sphingobacteriia, Order: Sphingobacteriales, Family: Chitinophagaceae, Genus:
atacggagggtgcaagcgttatccggatttactgggtttaaagggtgcgtaggtgggtaggtaagtcagtggtgaaatcttcaagcttaacttggaaactgccattgatactatttatcttgaattatctggaggtaagcggaatatgtcatgtagcggtgaaatgcttagatatgacatagaacacccattgcgaaggcagcttactacggatatattgacactgaggcacgaaagcgtggggatcaaacagg

SEQ ID NO: 356 - DNA, 254 bp, Unknown
  Kingdom: Bacteria, Phylum: Bacteroidetes, Class: Sphingobacteriia, Order: Sphingobacteriales, Family: Chitinophagaceae, Genus:
atacggagggtgcaagcgttatccggattcactgggtttaaagggtgcgtaggtgggcaagtaagtcagtggtgaaatctctgggcttaacccggaaactgccattgatactatttgtcttgaattctctggaggtaagcggaatatgtcatgtagcggtgaaatgcttagatatgacatagaacacccattgcgaaggcagcttactacggagacattgacactgaggcacgaaagcgtggggatcaaacagg

SEQ ID NO: 357 - DNA, 254 bp, Unknown
  Kingdom: Bacteria, Phylum: Bacteroidetes, Class: Sphingobacteriia, Order: Sphingobacteriales, Family: Chitinophagaceae, Genus:
atacggagggtgcaagcgttatccggattcactgggtttaaagggtgcgtaggcgggcaggtaagtcagtggtgaaatcctagagcttaactctagaactgccattgatactatctgtcttgaatattgtggaggtaagcggaatatgtcatgtagcggtgaaatgcttagatatgacatagaacacctattgcgaaggcagcttactacgcatatattgacgctgaggcacgaaagcgtggggatcaaacagg

SEQ ID NO: 358 - DNA, 254 bp, Unknown
  Kingdom: Bacteria, Phylum: Bacteroidetes, Class: Sphingobacteriia, Order: Sphingobacteriales, Family: Chitinophagaceae, Genus:
atacggagggtgcaagcgttatccggattcactgggtttaaagggtgcgtaggtgggcaggtaagtcagtggtgaaatctccgggcttaactcggaaactgccgttgatactatctgtcttgaatatcgtggaggttagcggaatatgtcatgtagcggtgaaatgcttagatatgacatagaacacccattgcgaaggcagctaactacacgatcattgacactgaggcacgaaagcgtggggagcaaacagg

SEQ ID NO: 359 - DNA, 254 bp, Unknown
  Kingdom: Bacteria, Phylum: Bacteroidetes, Class: Sphingobacteriia, Order: Sphingobacteriales, Family: Chitinophagaceae, Genus:
atacggagggtgcaagcgttatccggattcactgggtttaaagggtgcgtaggtgggtctgtaagtcagtggtgaaatctccaagcttaacttggaaactgccgttgatactatagctcttgaatgttgtggaggtgagcggaatatgtcatgtagcggtgaaatgcttagatatgacatagaacaccaattgcgaaggcagctcactacacaaatattgacactgaggcacgaaagcgtggggatcaaacagg

SEQ ID NO: 360 - DNA, 254 bp, Unknown
  Kingdom: Bacteria, Phylum: Bacteroidetes, Class: Sphingobacteriia, Order: Sphingobacteriales, Family: Chitinophagaceae, Genus:
atacggagggtgcaagcgttatccggattcactgggtttaaagggtgcgtaggcggattagtaagtccgtggtgaaatctccgagcttaactcggaaactgccatggatactattaatcttgaatgttgtggaggttagcggaatatgtcatgtagcggtgaaatgcttagatatgacatagaacaccaattgcgaaggcagctggctacacaaatattgacgctgaggcacgaaagcgtggggatcaaacagg

SEQ ID NO: 361 - DNA, 254 bp, Unknown
  Kingdom: Bacteria, Phylum: Bacteroidetes, Class: Sphingobacteriia, Order: Sphingobacteriales, Family: Chitinophagaceae, Genus:
atacggagggtgcaagcgttatccggattcactgggtttaaagggtgcgtaggtgggctagtaagtccgtggtgaaatctctgagcttaactcggaaactgccgtggatactattagtcttgaatctcgtggaggtaagcggaatatgtcatgtagcggtgaaaagcttagatatgacatagaacaccgatagcgaaggcagcttgctacacgagtattgacactgaggcacgaaagcgtggggatcaaacagg

SEQ ID NO: 362 - DNA, 254 bp, Unknown
  Kingdom: Bacteria, Phylum: Bacteroidetes, Class: Sphingobacteriia, Order: Sphingobacteriales, Family: Chitinophagaceae, Genus:
atacggagggtgcaagcgttatccggattcactgggtttaaagggtgcgtaggtgggctagtaagtccgtggtgaaatctccgagcttaactcggaaactgccgtggatactattagtcttgaatgtcgtggaggtaagcggaatatgtcatgtagcggtgaaatgcttagatatgacatagaacaccgatagcgaaggcagcttgctacacgatgattgacactgaggcacgaaagcgtggggatcaaacagg

SEQ ID NO: 363 - DNA, 254 bp, Unknown
  Kingdom: Bacteria, Phylum: Bacteroidetes, Class: Sphingobacteriia, Order: Sphingobacteriales, Family: Chitinophagaceae, Genus:
atacggagggtgcaagcgttatccggattcactgggtttaaagggtgcgtaggtgggttggtaagtcagtggtgaaatctccgtgcttaacatggaaactgccattgatactactggtcttgaattttctggaggtaagcggaatatgtcatgtagcggtgaaatgcttagatatgacatagaacaccaattgcgaaggcagcttactacagggatattgacactgaggcacgaaagcgtggggatcaaacagg

SEQ ID NO: 364 - DNA, 254 bp, Unknown
  Kingdom: Bacteria, Phylum: Bacteroidetes, Class: Sphingobacteriia, Order: Sphingobacteriales, Family: Chitinophagaceae, Genus:
atacggagggtgcaagcgttatccggattcactgggtttaaagggtgcgtaggtggagtggtaagtcagtggtgaaatctccaagcttaacttggaaactgccgttgatactatcattcttgaatatcgtggaggtaagcggaatatgtcatgtagcggtgaaatgcttagatatgacatagaacaccgattgcgaaggcagcttgctacacgatcattgacactgaggcacgaaagcgtggggatcaaacagg

SEQ ID NO: 365 - DNA, 254 bp, Unknown
  Kingdom: Bacteria, Phylum: Bacteroidetes, Class: Sphingobacteriia, Order: Sphingobacteriales, Family: Chitinophagaceae, Genus:
atacggagggtgcaagcgttatccggattcactgggtttaaagggtgcgtaggtgggttggtaagtcagtggtgaaatctccgagcttaacttggaaactgccgttgatactatcaatcttgaatatcgcgtaggtaagcggaatatgtcatgtagcggtgaaatgcttagatatgacatagaacaccaattgcgaaggcagcttacttcacgatcattgacactgaggcacgaaagcgtggggagcaaacagg

SEQ ID NO: 366 - DNA, 254 bp, Unknown
  Kingdom: Bacteria, Phylum: Bacteroidetes, Class: Sphingobacteriia, Order: Sphingobacteriales, Family: Chitinophagaceae, Genus:
atacggagggtgcaagcgttatccggattcactgggtttaaagggtgcgtaggtgggctagtaagtccgtggtgaaatctccaagcttaacttggaaactgccgtggatactattagtcttgaatattgtggaggtaagcggaatatgtcatgtagcggtgaaatgcttagatatgacatagaacaccgatagcgaaggcagcttgctacacaatcattgacactgaggcacgaaagcgtggggatcaaacagg

SEQ ID NO: 367 - DNA, 254 bp, Unknown
  Kingdom: Bacteria, Phylum: Bacteroidetes, Class: Sphingobacteriia, Order: Sphingobacteriales, Family: Chitinophagaceae, Genus:
atacggagggtgcaagcgttatccggatttactgggtttaaagggtgtgtaggcggacttttaagtcaggggtgaaatcccgaggctcaacctcggaactgcctttgatactattggtcttgaatgttgttgaggtgggcggaacgagtcatgtagcggtgaaatgcatagatatgacccggaacaccgattgcgaaggcagcccgctaagcaactattgacgctgaggcacgaaagcgtggggatcaaacagg

SEQ ID NO: 368 - DNA, 254 bp, Unknown
  Kingdom: Bacteria, Phylum: Bacteroidetes, Class: Sphingobacteriia, Order: Sphingobacteriales, Family: Chitinophagaceae, Genus:
atacggagggtgcaagcgttatccggattcactgggtttaaagggtgcgtaggcgggcaggtaagtcagtggtgaaatcctggagctcaactccagaactgccattgatactatctgtcttgaatattgtggaggtaagcggaatatgtcatgtagcggtgaaatgcttagatatgacatagaacacctattgcgaaggcagcttactacgcatatattgacgctgaggcacgaaagcgtggggatcaaacagg

SEQ ID NO: 369 - DNA, 254 bp, Unknown
  Kingdom: Bacteria, Phylum: Bacteroidetes, Class: Sphingobacteriia, Order: Sphingobacteriales, Family: Chitinophagaceae, Genus:
atacggagggtgcaagcgttatccggattcactgggtttaaagggtgcgtaggtgggtctgtaagtcagtggtgaaatccccgagcttaacttgggaactgccattgatactatagctcttgaatactgtggaggtcagcggaatatgtcatgtagcggtgaaatgcttagatatgacatagaacaccaattgcgaaggcagctggctacacaaatattgacactgaggcacgaaagcgtggggatcaaacagg

SEQ ID NO: 370 - DNA, 254 bp, Unknown
  Kingdom: Bacteria, Phylum: Bacteroidetes, Class: Sphingobacteriia, Order: Sphingobacteriales, Family: Chitinophagaceae, Genus:
atacggagggtgcaagcgttatccggattcactgggtttaaagggtgcgtaggtgggttggtaagtcagtggtgaaatccccgagcttaacttgggaactgccattgatactatcagtcttgaataccgtggaggtcagcggaatatgtcatgtagcggtgaaatgcttagatatgacatagaacaccaattgcgaaggcagctggctacacgaatattgacactgaggcacgaaagcgtggggatcaaacagg

SEQ ID NO: 371 - DNA, 254 bp, Unknown
  Kingdom: Bacteria, Phylum: Bacteroidetes, Class: Sphingobacteriia, Order: Sphingobacteriales, Family: Chitinophagaceae, Genus:
atacggagggtgcaagcgttatccggattcactgggtttaaagggtgcgtaggcgggcaggtaagtcagtggtgaaatcctggagcttaactccagaactgccattgatactatctgtcttgaatattgtggaggtaagcggaatatgtcatgtagcggtgaaatgcttagatatgacatagaacacctattgcgaaggcagcttactacgcatatattgacgctgaggcacgaaagcgtggggatcaaacagg

SEQ ID NO: 372 - DNA, 254 bp, Unknown
  Kingdom: Bacteria, Phylum: Bacteroidetes, Class: Sphingobacteriia, Order: Sphingobacteriales, Family: Chitinophagaceae, Genus:
atacggagggtgcaagcgttatccggattcactgggtttaaagggtgcgtaggcgggtatgtaagtcagtggtgaaataccggagcttaacttcggaactgccattgatactatatatcttgaatattgtggaggtaagcggaatatgtcatgtagcggtgaaatgcttagagatgacatagaacaccgattgcgaaggcagcttgctacgcaaatattgacgctgaggcacgaaagcgtggggatcaaacagg

SEQ ID NO: 373 - DNA, 254 bp, Unknown
  Kingdom: Bacteria, Phylum: Bacteroidetes, Class: Sphingobacteriia, Order: Sphingobacteriales, Family: Chitinophagaceae, Genus:
atacggagggtgcaagcgttatccggattcactgggtttaaagggtgcgtaggcggatttttaagtccgtggtgaaatctccgagcttaactcggaaactgccatggatactataagtcttgaatgttgtggaggtttgcggaatatgtcatgtagcggtgaaatgcttagatatgacatagaacaccgattgcgaaggcagcaggctacacaaatattgacgctgaggcacgaaagcgtggggatcaaacagg

SEQ ID NO: 374 - DNA, 254 bp, Unknown
  Kingdom: Bacteria, Phylum: Bacteroidetes, Class: Sphingobacteriia, Order: Sphingobacteriales, Family: env.OPS_17, Genus:
agacgaaggatgcaagcgttatccggattcattgggtttaaagggtgcgtaggcggacttgtaagtcagtggtgaaatctctcagcttaactgagaaactgccattgatactgcaggtctagagtatagatgacgttggcggaatatgacatgtagtggtgaaatacttagatatgtcatagaacaccgattgcgaaggcagctaacgaaactataactgacgctgaggcacgaaagtgcggggatcaaacagg

SEQ ID NO: 375 - DNA, 254 bp, Unknown
  Kingdom: Bacteria, Phylum: Bacteroidetes, Class: Sphingobacteriia, Order: Sphingobacteriales, Family: env.OPS_17, Genus:
agacgaaggatgcaagcgttatccggattcattgggtttaaagggagcgtaggtggccttataagtcagtggtgaaatctctgggcttaacccagaaattgccattgatactgtagggcttgagtacagttgctgtgggcggaatatgacatgtagtggtgaaatacatagagatgtcatagaacaccgattgcgaaggcagctcacaaaactgtaactgacactgaggctcgaaagtgcggggatcaaacagg

SEQ ID NO: 376 - DNA, 254 bp, Unknown
  Kingdom: Bacteria, Phylum: Bacteroidetes, Class: Sphingobacteriia, Order: Sphingobacteriales, Family: env.OPS_17, Genus:
atacggaggatccaagcgttatccggatttattgggtttaaagggtgcgtaggcgggacagtaagtcagtggtgaaatcctattgcttaacaatagaattgccattgatactgctgaccttgagtacaaatgatgtgggcggaatgtgcagtgtagcggtgaaatgcttagatattgcacagaacaccgatagcgaaggcagctcacaaaaatgtaactgacgctgaggcacgaaagtatggggatcaaacagg

SEQ ID NO: 377 - DNA, 254 bp, Unknown
  Kingdom: Bacteria, Phylum: Bacteroidetes, Class: Sphingobacteriia, Order: Sphingobacteriales, Family: KD3-93, Genus:
atacggaggatccaagcgttatccggattcattgggtttaaagggtgcgtaggcggaatgataagtcagtggtgaaagcctgcagcttaactgcagaactgccattgatactgtcaatcttgagtacatttgatgtgggcggaatgtgtcatgtagcggtgaaatgcttagatatgacacagaacaccgattgcgaaggcagctcacaaaactgtaactgacgctgaggcacgaaagcgtgggtatcaaacagg

SEQ ID NO: 378 - DNA, 254 bp, Unknown
  Kingdom: Bacteria, Phylum: Bacteroidetes, Class: Sphingobacteriia, Order: Sphingobacteriales, Family: NS11-12_marine_group, Genus:
atacggaggatccaagcgttgtccggatttattgggtttaaagggtgcgtaggcggacttataagtcagaggtgaaagccggtagcttaactatcgaattgcctttgaaactgcaagtcttgaattttgttgaggtaggcggaatgtatcatgtagcggtgaaatgcatagatatgatacagaacaccgattgcgaaggcagcttactaagcaaatattgacgctgaggcacgaaagcgtggggatcaaacagg

SEQ ID NO: 379 - DNA, 255 bp, Unknown
  Kingdom: Bacteria, Phylum: Bacteroidetes, Class: Sphingobacteriia, Order: Sphingobacteriales, Family: Saprospiraceae, Genus:
atacggagggtgcaagcgttatccggaatcactgggtttaaagggtgcgtaggcggtggcgtaagtcagttgtgaaataccccggcttaaccggtgggagtgcgattgatactgcgttacttgaatcaggttgaggtaggcggaatgtgacatgtagcggtgaaatgcttagatatgtcatagaacaccgattgcgaaggcagcttgctggacctgtattgacgctgaggcacgaaagcgtggggagcaaacagg

SEQ ID NO: 380 - DNA, 254 bp, Unknown
  Kingdom: Bacteria, Phylum: Bacteroidetes, Class: Sphingobacteriia, Order: Sphingobacteriales, Family: Saprospiraceae, Genus:
atacggagggtgcgagcgttatccggaattactgggtttaaagggtgcgtaggcggccaagtaagtcaggagtgaaagtttgcggctcaaccgtaaaattgcttttgatactgcttagctagaatcaggatgaggtcagcggaatgtggcatgtagcggtgaaatgcatagatatgccatagaacaccaattgcgaaggcagctggctagacctgtattgacgctgaggcacgaaagcgtggggagcgaacagg

SEQ ID NO: 381 - DNA, 254 bp, Unknown
  Kingdom: Bacteria, Phylum: Bacteroidetes, Class: Sphingobacteriia, Order: Sphingobacteriales, Family: Saprospiraceae, Genus:
atacggagggtgcgagcgttatccggaatcactgggtttaaagggtgcgtaggcggttatataagtcagtggtgaaaggccgtcgcttaacgatgggactgccattgatactgtataacttgagagaggttgaggttggcggaatgtggcatgtagcggtgaaatgcttagatatgccatagaacaccaattgcgaaggcagctgactagacctcatctgacgctgaggcacgaaagcgtggggagcgaacagg

SEQ ID NO: 382 - DNA, 251 bp, Unknown
  Kingdom: Bacteria, Phylum: Bacteroidetes, Class: Sphingobacteriia, Order: Sphingobacteriales, Family: Sphingobacteriaceae, Genus:
tacggaggatccaagcgttatccggatttattgggtttaaagggtgcgtaggtggcctattaagtcaggggtgaaagacggtagcttaactatcgcagtgcctttgatactgatgggcttgaatacacttgaggtaggcggaatgtgacaagtagcggtgaaatgcatagatatgtcacagaacaccaattgcgaaggcagcttactaaagtgattgacactgaggcacgaaagcgtggggatcaaacagg

SEQ ID NO: 383 - DNA, 254 bp, Unknown
  Kingdom: Bacteria, Phylum: Bacteroidetes, Class: Sphingobacteriia, Order: Sphingobacteriales, Family: Sphingobacteriaceae, Genus:
atacggaggatccaagcgttatccggatttattgggtttaaagggtgcgtaggcggcctgttaagtcaggggtgaaagacggtggctcaaccatcgcagtgcctttgatactgacgggcttgaatgcagctgaggtaggcggaatgtgacaagtagcggtgaaatgcatagatatgtcacagaacaccaattgcgaaggcagcttactaaagtgtgattgacgctgaggcacgaaagcgtggggatcaaacagg

SEQ ID NO: 384 - DNA, 254 bp, Unknown
  Kingdom: Bacteria, Phylum: Bacteroidetes, Class: Sphingobacteriia, Order: Sphingobacteriales, Family: Sphingobacteriaceae, Genus:
atacggaggatccaagcgttatccggatttattgggtttaaagggtgcgtaggcggcctattaagtcaggggtgaaagacggtagcttaactatcgcagtgcccttgatactgatgggcttgaatatacttgaggtaggcggaatgtgacaagtagcggtgaaatgcatagatatgtcacagaacaccaattgcgaaggcagcttactaaggtatgattgacgctgaggcacgaaagcgtggggatcaaacagg

SEQ ID NO: 385 - DNA, 254 bp, Unknown
  Kingdom: Bacteria, Phylum: Bacteroidetes, Class: Sphingobacteriia, Order: Sphingobacteriales, Family: Sphingobacteriaceae, Genus:
atacggaggatccgagcgttatccggatttattgggtttaaagggtgcgtaggcggcctattaagtcaggggtgaaagacggtagcttaactatcgcagtgcctttgatactgataggcttgaatgtacttgaggtaggcggaatgtgacaagtagcggtgaaatgcatagatatgtcacagaacaccaattgcgaaggcagcttactaaagtatgattgacgctgaggcacgaaagcgtggggatcaaacagg

SEQ ID NO: 386 - DNA, 251 bp, Unknown
  Kingdom: Bacteria, Phylum: Bacteroidetes, Class: Sphingobacteriia, Order: Sphingobacteriales, Family: Sphingobacteriaceae, Genus:
tacggaggatccaagcgttatccggatttattgggtttaaagggtgcgtaggcggcccgttaagtcaggggtgaaagacggtagctcaactatcgcagtgcctttgatactgacgggcttgaatgaactagaggtaggcggaatgagacaagtagcggtgaaatgcatagatatgtctcagaacaccgattgcgaaggcagcttactatggttattgacgctgaggcacgaaagcgtggggatcaaacagg

SEQ ID NO: 387 - DNA, 251 bp, Unknown
  Kingdom: Bacteria, Phylum: Bacteroidetes, Class: Sphingobacteriia, Order: Sphingobacteriales, Family: Sphingobacteriaceae, Genus:
tacggaggatccaagcgttatccggatttattgggtttaaagggtgcgtaggtggttttttaagtcaggggtgaaagacggcagcttaactgtcgcagtgcctttgatactgaagaacttgaatgaactagaggtaggcggaatgtgacaagtagcggtgaaatgcatagatatgtcacagaacaccaattgcgaaggcagcttactatggttattgacactgaggcacgaaagcgtggggatcaaacagg

SEQ ID NO: 388 - DNA, 251 bp, Unknown
  Kingdom: Bacteria, Phylum: Bacteroidetes, Class: Sphingobacteriia, Order: Sphingobacteriales, Family: Sphingobacteriaceae, Genus:
tacggaggatccaagcgttatccggatttattgggtttaaagggtgcgtaggcggcttattaagtcaggggtgaaagacggtggctcaaccatcgcagtgcccttgatactgatgagcttgaatgaactagaggtaggcggaatgtgacaagtagcggtgaaatgcatagatatgtcacagaacaccgattgcgaaggcagcttactatggttattgacgctgaggcacgaaagcgtggggatcaaacagg

SEQ ID NO: 389 - DNA, 254 bp, Unknown
  Kingdom: Bacteria, Phylum: Bacteroidetes, Class: Sphingobacteriia, Order: Sphingobacteriales, Family: Sphingobacteriaceae, Genus:
atacggaggatccaagcgttatccggatttattgggtttaaagggtgcgtaggcggcttattaagtcaggggtgaaagacggtggctcaaccatcgcagtgcccttgatactgatgagcttgaatacactagaggtaggcggaatgtgacaagtagcggtgaaatgcatagatatgtcacagaacaccgattgcgaaggcagcttactatggtgtgattgacgctgaggcacgaaagcgtggggatcaaacagg

SEQ ID NO: 390 - DNA, 254 bp, Unknown
  Kingdom: Bacteria, Phylum: Bacteroidetes, Class: Sphingobacteriia, Order: Sphingobacteriales, Family: Sphingobacteriaceae, Genus:
atacggaggatccaagcgttatccggatttattgggtttaaagggtgcgtaggcggcctgttaagtcaggggtgaaagacggtagctcaactatcgcagtgcccttgatactgatgggcttgaatggactagaggtaggcggaatgtgacaagtagcggtgaaatgcatagatatgtcacagaacaccgattgcgaaggcagcttactatggtcttattgacgctgaggcacgaaagcgtggggatcaaacagg

SEQ ID NO: 391 - DNA, 251 bp, Unknown
  Kingdom: Bacteria, Phylum: Bacteroidetes, Class: Sphingobacteriia, Order: Sphingobacteriales, Family: Sphingobacteriaceae, Genus:
tacgggggatccgagcgttatccggatttattgggtttaaagggtgcgtaggcggcctattaagtcaggggtgaaagacggtagctcaactatcgcagtgcctttgatactgatgggcttgaatacacttgaggtaggcggaatgtgacaagtagcggtgaaatgcatagatatgtcacagaacaccaattgcgaaggcagcttactaaagtgattgacgctgaggcacgaaagcgtggggatcaaacagg

SEQ ID NO: 392 - DNA, 254 bp, Unknown
  Kingdom: Bacteria, Phylum: Bacteroidetes, Class: Sphingobacteriia, Order: Sphingobacteriales, Family: Sphingobacteriaceae, Genus:
atacggaggatccaagcgttatccggatttattgggtttaaagggtgcgtaggcggcttattaagtcaggggtgaaagacggtggctcaaccatcgcagtgcctttgatactgatgagcttgaatacactagaggtaggcggaatgtgacaagtagcggtgaaatgcatagatatgtcacagaacaccgattgcgaaggcagcttactatggtgtcattgacgctgaggcacgaaagcgtggggatcaaacagg

SEQ ID NO: 393 - DNA, 254 bp, Unknown
  Kingdom: Bacteria, Phylum: Bacteroidetes, Class: Sphingobacteriia, Order: Sphingobacteriales, Family: Sphingobacteriaceae, Genus:
atacggaggatccaagcgttatccggatttattgggtttaaagggtgcgtaggcggcctgttaagtcaggggtgaaagacggtagctcaactatcgcagtgcctttgatactgatgggcttgaatgaactagaggtaggcggaatgagacaagtagcggtgaaatgcatagatatgtctcagaacaccgattgcgaaggcagcttactatggtttaattgacgctgaggcacgaaagcgtggggatcaaacagg

SEQ ID NO: 394 - DNA, 254 bp, Unknown
  Kingdom: Bacteria, Phylum: Bacteroidetes, Class: Sphingobacteriia, Order: Sphingobacteriales, Family: Sphingobacteriaceae, Genus:
atacggaggatccgagcgttatccggatttattgggtttaaagggtgcgtaggcggcctgttaagtcaggggtgaaagacggtagctcaactatcgcagtgcccttgatactgatgggcttgaatgtactagaggtaggcggaatgtgacaagtagcggtgaaatgcatagatatgtcacagaacaccaattgcgaaggcagcttactatggtattattgacgctgaggcacgaaagcgtggggatcaaacagg

SEQ ID NO: 395 - DNA, 251 bp, Unknown
  Kingdom: Bacteria, Phylum: Bacteroidetes, Class: Sphingobacteriia, Order: Sphingobacteriales, Family: Sphingobacteriaceae, Genus:
tacggaggatccgagcgttatccggatttattgggtttaaagggtgcgtaggcggcctgttaagtcaggggtgaaagacggtagctcaactatcgcagtgcccttgatactgatgggcttgaatgtactagaggtaggcggaatgtgacaagtagcggtgaaatgcatagatatgtcacagaacaccaattgcgaaggcagcttactatggtaattgacgctgaggcacgaaagcgtggggatcaaacagg

SEQ ID NO: 396 - DNA, 251 bp, Unknown
  Kingdom: Bacteria, Phylum: Bacteroidetes, Class: Sphingobacteriia, Order: Sphingobacteriales, Family: Sphingobacteriaceae, Genus:
tacggaggatccaagcgttatccggatttattgggtttaaagggtgcgtaggtggcctggtaagtcaggggtgaaagacggcagcttaactgtcgcagtgcctttgatactgccgggcttgaatacagttgaagtgggcggaatgtgacaagtagcggtgaaatgcatagatatgtcacagaacaccgatcgcgaaggcagctcactaaagtgattgacactgaggcacgaaagcgtggggatcaaacagg

SEQ ID NO: 397 - DNA, 254 bp, Unknown
  Kingdom: Bacteria, Phylum: Bacteroidetes, Class: Sphingobacteriia, Order: Sphingobacteriales, Family: Sphingobacteriaceae, Genus:
atacggaggatccaagcgttatccggatttattgggtttaaagggtgcgtaggcggcctattaagtcaggggtgaaagacggtggctcaaccatcgcagtgcctttgatactgataggcttgaatgaactagaggtaggcggaatgtgacaagtagcggtgaaatgcatagatatgtcacagaacaccgattgcgaaggcagcttactatggtttaattgacgctgaggcacgaaagcgtggggatcgaacagg

SEQ ID NO: 398 - DNA, 254 bp, Unknown
  Kingdom: Bacteria, Phylum: Bacteroidetes, Class: Sphingobacteriia, Order: Sphingobacteriales, Family: Sphingobacteriaceae, Genus:
atacggaggatccaagcgttatccggatttattgggtttaaagggtgcgtaggcggcctgttaagtcaggggtgaaagacggtagctcaactatcgcagtgcccttgatactgatgggcttgaatgtactagaggtaggcggaatgtgacaagtagcggtgaaatgcatagatatgtcacagaacaccaattgcgaaggcagcttactatggtatgattgacgctgaggcacgaaagcgtggggatcaaacagg

SEQ ID NO: 399 - DNA, 254 bp, Unknown
  Kingdom: Bacteria, Phylum: Bacteroidetes, Class: Sphingobacteriia, Order: Sphingobacteriales, Family: Sphingobacteriaceae, Genus:
atacggaggatccaagcgttatccggatttattgggtttaaagggtgcgtaggtggcctgttaagtcaggggtgaaagacggtagctcaactatcgcagtgcccttgatactgatgggcttgaatgaactagaggtaggcggaatgtgacaagtagcggtgaaatgcatagatatgtcacagaacaccaattgcgaaggcagcttactatggtttaattgacactgaggcacgaaagcgtggggatcaaacagg

SEQ ID NO: 400 - DNA, 254 bp, Unknown
  Kingdom: Bacteria, Phylum: Bacteroidetes, Class: Sphingobacteriia, Order: Sphingobacteriales, Family: Sphingobacteriaceae, Genus:
atacggaggatccaagcgttatccggatttattgggtttaaagggtgcgtaggtggttttttaagtcaggggtgaaagacggcagcttaactgtcgcagtgcctttgatactgaagaacttgaattaactagaggtaggcggaatgtgacaagtagcggtgaaatgcatagatatgtcacagaacaccaattgcgaaggcagcttactatggttatattgacactgaggcacgaaagcgtggggatcaaacagg

SEQ ID NO: 401 - DNA, 251 bp, Unknown
  Kingdom: Bacteria, Phylum: Bacteroidetes, Class: Sphingobacteriia, Order: Sphingobacteriales, Family: Sphingobacteriaceae, Genus:
tacggaggatccaagcgttatccggatttattgggtttaaagggtgcgtaggcggcttattaagtcaggggtgaaaggcggtagcttaactatcggagtgcccttgatactgatgagcttgaatgcagctgaggtaggcggaatgtgacaagtagcggtgaaatgcatagatatgtcacagaacaccgattgcgaaggcagcttactaaagtgattgacgctgaggcacgaaagcgtggggatcaaacagg

SEQ ID NO: 402 - DNA, 254 bp, Unknown
  Kingdom: Bacteria, Phylum: Bacteroidetes, Class: Sphingobacteriia, Order: Sphingobacteriales, Family: Sphingobacteriaceae, Genus:
atacggaggatccaagcgttatccggatttattgggtttaaagggtgcgtaggcggctttttaagtcaggggtgaaagacggtagctcaactatcgcagtgcccttgatactgaagagcttgaatgaactagaggtaggcggaatgtgacaagtagcggtgaaatgcatagatatgtcacagaacaccgattgcgaaggcagcttactatggtttaattgacgctgaggcacgaaagcgtggggatcaaacagg

SEQ ID NO: 403 - DNA, 251 bp, Unknown
  Kingdom: Bacteria, Phylum: Bacteroidetes, Class: Sphingobacteriia, Order: Sphingobacteriales, Family: Sphingobacteriaceae, Genus:
tacggaggatccaagcgttatccggatttattgggtttaaagggtgcgtaggtggttcattaagtcaggggtgaaagacggcagcttaactgtcgcagtgcctttgatactgatgaacttgaatgaactagaggtaggcggaatgtgacaagtagcggtgaaatgcatagatatgtcacagaacaccaattgcgaaggcagcttactatggttattgacactgaggcacgaaagcgtggggatcaaacagg

SEQ ID NO: 404 - DNA, 251 bp, Unknown
  Kingdom: Bacteria, Phylum: Bacteroidetes, Class: Sphingobacteriia, Order: Sphingobacteriales, Family: Sphingobacteriaceae, Genus:
tacggaggatccaagcgttatccggatttattgggtttaaagggtgcgtaggcggcctattaagtcaggggtgaaagacggtagcttaactatcgcagtgcctttgatactgatgggcttgaatgtacttgaggtaggcggaatgtgacaagtagcggtgaaatgcatagatatgtcacagaacaccaattgcgaaggcagcttactaaagtaattgacgctgaggcacgaaagcgtggggatcaaacagg

SEQ ID NO: 405 - DNA, 251 bp, Unknown
  Kingdom: Bacteria, Phylum: Bacteroidetes, Class: Sphingobacteriia, Order: Sphingobacteriales, Family: Sphingobacteriaceae, Genus:
tacggaggatccaagcgttatccggatttattgggtttaaagggtgcgtaggcggcttattaagtcaggggtgaaagacggtggctcaaccatcgcagtgcccttgatactgatgagcttgaatggactagaggtaggcggaatgtgacaagtagcggtgaaatgcatagatatgtcacagaacaccgattgcgaaggcagcttactatggtcattgacgctgaggcacgaaagcgtggggatcaaacagg

SEQ ID NO: 406 - DNA, 254 bp, Unknown
  Kingdom: Bacteria, Phylum: Bacteroidetes, Class: Sphingobacteriia, Order: Sphingobacteriales, Family: Sphingobacteriaceae, Genus:
atacggaggatccaagcgttatccggatttattgggtttaaagggtgcgtaggcggcctattaagtcaggggtgaaagacggtagcttaactatcgcagtgcctttgatactgataggcttgaatgtacttgaggtaggcggaatgtgacaagtagcggtgaaatgcatagatatgtcacagaacaccaattgcgaaggcagcttactaaagtatgattgacgctgaggcacgaaagcgtggggatcaaacagg

SEQ ID NO: 407 - DNA, 254 bp, Unknown
  Kingdom: Bacteria, Phylum: Bacteroidetes, Class: Sphingobacteriia, Order: Sphingobacteriales, Family: Sphingobacteriaceae, Genus:
atacggaggatccgagcgttatccggatttattgggtttaaagggtgcgtaggtggcctgttaagtcaggggtgaaagacggtagctcaactatcgcagtgcccttgatactgatgggcttgaatgaactagaggtaggcggaatgtgacaagtagcggtgaaatgcatagatatgtcacagaacaccaattgcgaaggcagcttactatggttttattgacactgaggcacgaaagcgtggggatcaaacagg

SEQ ID NO: 408 - DNA, 253 bp, Unknown
  Kingdom: Bacteria, Phylum: Bacteroidetes, Class: Sphingobacteriia, Order: Sphingobacteriales, Family: Sphingobacteriaceae, Genus:
atacggaggatccgagcgttatccggatttattgggtttaagggtgcgtaggcggccttgtaagtcaggggtgaaagacggtagctcaactatcgcagtgcctttgatactgcagggcttgaatgtacttgaggtaggcggaatgtgacaagtagcggtgaaatgcatagatatgtcacagaacaccaattgcgaaggcagcttactaaagtatgattgacgctgaggcacgaaagcgtggggatcaaacagg

SEQ ID NO: 409 - DNA, 254 bp, Unknown
  Kingdom: Bacteria, Phylum: Bacteroidetes, Class: Sphingobacteriia, Order: Sphingobacteriales, Family: Sphingobacteriaceae, Genus:
atacggaggatccaagcgttatccggatttattgggtttaaagggtgcgtaggtggttttttaagtcaggggtgaaagacggcagcttaactgtcgcagtgcctttgatactgaagaacttgaatgaactagaggtaggcggaatgtgacaagtagcggtgaaatgcatagatatgtcacagaacaccaattgcgaaggcagcttactatggtttgattgacactgaggcacgaaagcgtggggatcaaacagg

SEQ ID NO: 410 - DNA, 254 bp, Unknown
  Kingdom: Bacteria, Phylum: Bacteroidetes, Class: Sphingobacteriia, Order: Sphingobacteriales, Family: Sphingobacteriaceae, Genus:
  misc_feature (9)..(9): n is a, c, g, or t
atacggagnatccaagcgttatccggatttattgggtttaaagggtgcgtaggtggttctttaagtcaggggtgaaagacggtagcttaactatcgcagtgcctttgatactgaagaacttgaatacactagaggtaggcggaatgtgacaagtagcggtgaaatgcatagatatgtcacagaacaccaattgcgaaggcagcttactatggtgtcattgacactgaggcacgaaagcgtggggatcaaacagg

SEQ ID NO: 411 - DNA, 251 bp, Unknown
  Kingdom: Bacteria, Phylum: Bacteroidetes, Class: Sphingobacteriia, Order: Sphingobacteriales, Family: Sphingobacteriaceae, Genus:
tacggaggatccaagcgttatccggatttattgggtttaaagggtgcgtaggcggcctgttaagtcaggggtgaaagacggtagctcaactatcgcagtgcccttgatactgatgggcttgaatggactagaggtaggcggaatgagacaagtagcggtgaaatgcatagatatgtctcagaacaccgattgcgaaggcagcttactatggtcattgacgctgaggcacgaaagcgtggggatcaaacagg

SEQ ID NO: 412 - DNA, 254 bp, Unknown
  Kingdom: Bacteria, Phylum: Bacteroidetes, Class: Sphingobacteriia, Order: Sphingobacteriales, Family: Sphingobacteriaceae, Genus:
atacggaggatccaagcgttatccggatttattgggtttaaagggtgcgtaggcggcttattaagtcaggggtgaaagacggtggctcaaccatcgcagtgcccttgatactgatgagcttgaatgaactagaggtaggcggaatgtgacaagtagcggtgaaatgcatagatatgtcacagaacaccgattgcgaaggcagcttactatggttttattgacgctgaggcacgaaagcgtggggatcaaacagg

SEQ ID NO: 413 - DNA, 251 bp, Unknown
  Kingdom: Bacteria, Phylum: Bacteroidetes, Class: Sphingobacteriia, Order: Sphingobacteriales, Family: Sphingobacteriaceae, Genus:
tacggaggatccaagcgttatccggatttattgggtttaaagggtgcgtaggcggcttattaagtcaggggtgaaagacggtggctcaaccatcgcagtgcccttgatactgatgagcttgaatacactagaggtaggcggaatgtgacaagtagcggtgaaatgcatagatatgtcacagaacaccgattgcgaaggcagcttactatggtgattgacgctgaggcacgaaagcgtggggatcaaacagg

SEQ ID NO: 414 - DNA, 251 bp, Unknown
  Kingdom: Bacteria, Phylum: Bacteroidetes, Class: Sphingobacteriia, Order: Sphingobacteriales, Family: Sphingobacteriaceae, Genus:
tacggaggatccaagcgttatccggatttattgggtttaaagggtgcgtaggcggcctgttaagtcaggggtgaaagacggtagctcaactatcgcagtgcctttgatactgatgggcttgaatgaactagaggtaggcggaatgagacaagtagcggtgaaatgcatagatatgtctcagaacaccgattgcgaaggcagcttactatggttattgacgctgaggcacgaaagcgtggggatcaaacagg

SEQ ID NO: 415 - DNA, 254 bp, Unknown
  Kingdom: Bacteria, Phylum: Bacteroidetes, Class: Sphingobacteriia, Order: Sphingobacteriales, Family: Sphingobacteriaceae, Genus:
atacggaggatccaagcgttatccggatttattgggtttaaagggtgcgtaggtggcctgttaagtcaggggtgaaagacggtagcttaactatcgcagtgcccttgatactgatgggcttgaatgaactagaggtaggcggaatgtgacaagtagcggtgaaatgcatagatatgtcacagaacaccaattgcgaaggcagcttactatggttttattgacactgaggcacgaaagcgtggggatcaaacagg

SEQ ID NO: 416 - DNA, 254 bp, Unknown
  Kingdom: Bacteria, Phylum: Bacteroidetes, Class: Sphingobacteriia, Order: Sphingobacteriales, Family: Sphingobacteriaceae, Genus:
atacggaggatccaagcgttatccggatttattgggtttaaagggtgcgtaggcggtcctataagtcagtggtgaaagacggcagcttaactgtcgcagtgcctttgatactgtaggacttgaatctatttgaagtgggcggaataagacaagtagcggtgaaatgcatagatatgtcttagaactccgattgcgaaggcagctcactaagttagtattgacgctgatgcacgaaagcgtggggatcaaacagg

SEQ ID NO: 417 - DNA, 254 bp, Unknown
  Kingdom: Bacteria, Phylum: Bacteroidetes, Class: Sphingobacteriia, Order: Sphingobacteriales, Family: Sphingobacteriaceae, Genus:
atacggaggatccaagcgttatccggatttattgggtttaaagggtgcgtaggcggcctgttaagtcaggggtgaaagacggtagctcaactatcgcagtgcccttgatactgacgggcttgaatgaactagaggtaggcggaatgtgacaagtagcggtgaaatgcatagatatgtcacagaacaccgattgcgaaggcagcttactatggttttattgacgctgaggcacgaaagcgtggggatcaaacagg

SEQ ID NO: 418 - DNA, 254 bp, Unknown
  Kingdom: Bacteria, Phylum: Bacteroidetes, Class: Sphingobacteriia, Order: Sphingobacteriales, Family: Sphingobacteriaceae, Genus:
atacggaggatccgagcgttatccggatttattgggtttaaagggtgcgtaggcggcctgttaagtcaggggtgaaagacggtagctcaactatcgcagtgcccttgatactgatgggcttgaatgtactagaggtaggcggaatgtgacaagtagcggtgaaatgcatagatatgtcacagaacaccaattgcgaaggcagcttactatggtatgattgacgctgaggcacgaaagcgtggggatcaaacagg

SEQ ID NO: 419 - DNA, 254 bp, Unknown
  Kingdom: Bacteria, Phylum: Bacteroidetes, Class: Sphingobacteriia, Order: Sphingobacteriales, Family: Sphingobacteriaceae, Genus:
atacggaggatccaagcgttatccggatttattgggtttaaagggtgcgtaggcggctttttaagtcaggggtgaaagacggtagctcaactatcgcagtgcccttgatactgaagagcttgaatgtacttgaggtaggcggaatgtgacaagtagcggtgaaatgcatagatatgtcacagaacaccaattgcgaaggcagcttactaaagtatgattgacgctgaggcacgaaagcgtggggatcaaacagg

SEQ ID NO: 420 - DNA, 254 bp, Unknown
  Kingdom: Bacteria, Phylum: Bacteroidetes, Class: Sphingobacteriia, Order: Sphingobacteriales, Family: Sphingobacteriaceae, Genus:
atacggaggatccaagcgttatccggatttattgggtttaaagggtgcgtaggcggcctgttaagtcaggggtgaaagacggtagctcaactatcgcagtgcccttgatactgatgggcttgaatacactagaggtaggcggaatgtgacaagtagcggtgaaatgcatagatatgtcacagaacaccgattgcgaaggcagcttactatggtgtcattgacgctgaggcacgaaagcgtggggatcaaacagg

SEQ ID NO: 421 - DNA, 254 bp, Unknown
  Kingdom: Bacteria, Phylum: Bacteroidetes, Class: Sphingobacteriia, Order: Sphingobacteriales, Family: Sphingobacteriaceae, Genus:
atacggaggatccaagcgttatccggatttattgggtttaaagggtgcgtaggcggcttattaagtcaggggtgaaagacggtggctcaaccatcgcagtgcccttgatactgatgagcttgaatacactagaggtaggcggaatgtgacaagtagcggtgaaatgcatagatatgtcacagaacaccgattgcgaaggcagcttactatggtgttattgacgctgaggcacgaaagcgtggggatcaaacagg

SEQ ID NO: 422 - DNA, 251 bp, Unknown
  Kingdom: Bacteria, Phylum: Bacteroidetes, Class: Sphingobacteriia, Order: Sphingobacteriales, Family: Sphingobacteriaceae, Genus:
tacggaggatccaagcgttatccggatttattgggtttaaagggtgcgtaggcggcctgttaagtcagaggtgaaagacggtagctcaactatcgcagtgcctttgatactgacgggcttgaatgaactagaggtaggcggaatgagacaagtagcggtgaaatgcatagatatgtctcagaacaccgattgcgaaggcagcttactatggttattgacgctgaggcacgaaagcgtggggatcaaacagg

SEQ ID NO: 423 - DNA, 254 bp, Unknown
  Kingdom: Bacteria, Phylum: Bacteroidetes, Class: Sphingobacteriia, Order: Sphingobacteriales, Family: Sphingobacteriaceae, Genus:
atacggaggatccaagcgttatccggatttattgggtttaaagggtgcgtaggcggcctgttaagtcaggggtgaaagacggtagctcaactatcgcagtgcccttgatactgatgggcttgaatggactagaggtaggcggaatgagacaagtagcggtgaaatgcatagatatgtctcagaacaccgattgcgaaggcagcttactatggtcttattgacgctgaggcacgaaagcgtggggatcaaacagg

SEQ ID NO: 424 - DNA, 251 bp, Unknown
  Kingdom: Bacteria, Phylum: Bacteroidetes, Class: Sphingobacteriia, Order: Sphingobacteriales, Family: Sphingobacteriaceae, Genus:
tacggaggatccaagcgttatccggatttattgggtttaaagggtgcgtaggcggcctgttaagtcaggggtgaaagacggtagctcaactatcgcagtgcccttgatactgatgggcttgaatgaactagaggtaggcggaatgagacaagtagcggtgaaatgcatagatatgtctcagaacaccgattgcgaaggcagcttactatggttattgacgctgaggcacgaaagcgtggggatcaaacagg

SEQ ID NO: 425 - DNA, 254 bp, Unknown
  Kingdom: Bacteria, Phylum: Bacteroidetes, Class: Sphingobacteriia, Order: Sphingobacteriales, Family: Sphingobacteriaceae, Genus:
atacggaggatccaagcgttatccggatttattgggtttaaagggtgcgtaggcggcctgttaagtcaggggtgaaagacggtagctcaactatcgcagtgcccttgatactgacgggcttgaatagactagaggtaggcggaatgtgacaagtagcggtgaaatgcatagatatgtcacagaacaccgattgcgaaggcagcttactatggtctgattgacgctgaggcacgaaagcgtggggatcaaacagg

SEQ ID NO: 426 - DNA, 254 bp, Unknown
  Kingdom: Bacteria, Phylum: Bacteroidetes, Class: Sphingobacteriia, Order: Sphingobacteriales, Family: Sphingobacteriaceae, Genus:
atacggaggatccaagcgttatccggatttattgggtttaaagggtgcgtaggcggcctattaagtcaggggtgaaagacggtagcttaactatcgcagtgcctttgatactgatgggcttgaatgtacttgaggtaggcggaatgtgacaagtagcggtgaaatgcatagatatgtcacagaacaccaattgcgaaggcagcttactaaagtatgattgacgctgaggcacgaaagcgtggggatcaaacagg

SEQ ID NO: 427 - DNA, 251 bp, Unknown
  Kingdom: Bacteria, Phylum: Bacteroidetes, Class: Sphingobacteriia, Order: Sphingobacteriales, Family: Sphingobacteriaceae, Genus:
tacggaggatccaagcgttatccggatttattgggtttaaagggtgcgtaggcggcctattaagtcaggggtgaaagacggtagcttaactatcgcagtgcctttgatactgatgggcttgaatacacttgaggtaggcggaatgtgacaagtagcggtgaaatgcatagatatgtcacagaacaccaattgcgaaggcagcttactaaagtgattgacgctgaggcacgaaagcgtggggatcaaacagg

SEQ ID NO: 428 - DNA, 254 bp, Unknown
  Kingdom: Bacteria, Phylum: Bacteroidetes, Class: Sphingobacteriia, Order: Sphingobacteriales, Family: Sphingobacteriaceae, Genus:
atacggaggatccaagcgttatccggatttattgggtttaaagggtgcgtaggcggcttattaagtcaggggtgaaagacggtggctcaaccatcgcagtgcctttgatactgatgagcttgaatgaactagaggtaggcggaatgtgacaagtagcggtgaaatgcatagatatgtcacagaacaccgattgcgaaggcagcttactatggttttattgacgctgaggcacgaaagcgtggggatcaaacagg

SEQ ID NO: 429 - DNA, 254 bp, Unknown
  Kingdom: Bacteria, Phylum: Bacteroidetes, Class: Sphingobacteriia, Order: Sphingobacteriales, Family: Sphingobacteriaceae, Genus:
atacggaggatccaagcgttatccggatttattgggtttaaagggtgcgtaggtggttctttaagtcaggggtgaaagacggcagcttaactgtcgcagtgcctttgatactgaagaacttgaatacactagaggtaggcggaatgtgacaagtagcggtgaaatgcatagatatgtcacagaacaccaattgcgaaggcagcttactatggtgtcattgacactgaggcacgaaagcgtggggatcaaacagg

SEQ ID NO: 430 - DNA, 254 bp, Unknown
  Kingdom: Bacteria, Phylum: Bacteroidetes, Class: Sphingobacteriia, Order: Sphingobacteriales, Family: Sphingobacteriaceae, Genus:
atacggaggatccaagcgttatccggatttattgggtttaaagggtgcgtaggtggcctattaagtcaggggtgaaagacggtagcttaactatcgcagtgcctttgatactgatgggcttgaatacagttgaagtaggcggaatgtgacaagtagcggtgaaatgcatagatatgtcacagaacaccgattgcgaaggcagcttactaaagtgtgattgacactgaggcacgaaagcgtggggatcaaacagg

SEQ ID NO: 431 - DNA, 251 bp, Unknown
  Kingdom: Bacteria, Phylum: Bacteroidetes, Class: Sphingobacteriia, Order: Sphingobacteriales, Family: Sphingobacteriaceae, Genus:
tacggaggatccgagcgttatccggatttattgggtttaaagggtgcgtaggcggcctattaagtcaggggtgaaatacggtggctcaaccatcgcagtgcctttgatactgatgggcttgaatccatttgaagtgggcggaataagacaagtagcggtgaaatgcatagatatgtcttagaactccgattgcgaaggcagctcactaagctgattgacgctgatgcacgaaagcgtggggatcgaacagg

SEQ ID NO: 432 - DNA, 254 bp, Unknown
  Kingdom: Bacteria, Phylum: Bacteroidetes, Class: Sphingobacteriia, Order: Sphingobacteriales, Family: Sphingobacteriaceae, Genus:
atacggaggatccaagcgttatccggatttattgggtttaaagggtgcgtaggcggcctgttaagtcaggggtgaaagacggtagctcaactatcgcagtgcccttgatactgatgggcttgaatgtacttgaggtaggcggaatgtgacaagtagcggtgaaatgcatagatatgtcacagaacaccaattgcgaaggcagcttactaaagtatgattgacgctgaggcacgaaagcgtggggatcaaacagg

SEQ ID NO: 433 - DNA, 251 bp, Unknown
  Kingdom: Bacteria, Phylum: Bacteroidetes, Class: Sphingobacteriia, Order: Sphingobacteriales, Family:  , Genus:
tacggaggatccaagcgttgtccggatttattgggtttaaagggtgcgtaggcggacttataagtcagaggtgaaagccggtagcttaactatcgaattgcctttgaaactgtaagtcttgaattttgttgaggtaggcggaatgtatcatgtagcggtgaaatgcatagatatgatacagaacaccgattgcgaaggcagcttactaagcaaattgacgctgaggcacgaaagcgtggggatcaaacagg

SEQ ID NO: 434 - DNA, 254 bp, Unknown
  Kingdom: Bacteria, Phylum: Bacteroidetes, Class: VC2.1_Bac22, Order:  , Family:  , Genus:
atacggaggatccaagcgttatccggatttattgggtttaaagggtgcgtaggtgggataataagtcagaggtgaaagctagcagcttaactgttaaattgcctttgatactgttattcttgagtgtagttggcgttggcggaatgtgacatgtagcggtgaaatgcgtagatatgtcacagaacaccgatcgcgaaggcagctaacgaaactatcactgacactgatgcacgaaagcgtggggagcaaacagg

SEQ ID NO: 435 - DNA, 253 bp, Unknown
  Kingdom: Bacteria, Phylum: Bacteroidetes, Class:  , Order:  , Family:  , Genus:
tacgtaggtggcaagcgttgtccggatttattgggtttaaagggtgcgtaggcggtctattaagtcagtggtgaaatatggcagcttaactgtcagggtgccattgatactgatggacttgagtgaagtcgaagtaggcggaattgacggtgtagcggtgaaatgcttagatatcgtcaagaacaccgatagtgaagacagcttactaggcttatactgacgctgaggcacgaaagtgtggggatcaaacagg

SEQ ID NO: 436 - DNA, 256 bp, Unknown
  Kingdom: Bacteria, Phylum: Candidate_division_TM7, Class:  , Order:  , Family:  , Genus:
atacgtagggtgcaagcattatccggagtgactgggcgtaaagagttgcgtaggtggtttgttaagtgaatagtgaaatctgggggctcaacctcacagactattattcaaactggcagactcgagaatggtagaggtaactggaatttctagtgtaggagtgaaatccgtagatattagaaggaacaccaatggcgtaggcaggttactggaccatttctgacactgaggcacgaaagcgtggggagcgaaccgg

SEQ ID NO: 437 - DNA, 253 bp, Unknown
  Kingdom: Bacteria, Phylum: Chlamydiae, Class: Chlamydiia, Order: Chlamydiales, Family: Parachlamydiaceae, Genus:
tacggagggtgcaagcattaatcggatttattgggcgtaaagggcgcgtaggcggggatataagtcagatgtgaaatcctggggctcaacctcagaactgcatttgaaactgtatctctagagggtaggaggagaaaacggaattccacaagtagcggtgaaatgcgtagatatgtggaagaacaccggtggcgaaggcggttttctatcttattcctgacgctgaggcgcgaaagcaaggggatcaaacagg

SEQ ID NO: 438 - DNA, 251 bp, Unknown
  Kingdom: Bacteria, Phylum: Chlamydiae, Class: Chlamydiia, Order: Chlamydiales, Family:  , Genus:
tacggagggtgcaagcattgatcggaattactgggcgtaaagggcgcgtaggcggctagaaaagtcagatgtgaaattccggggctcaaccccggagctgcatttgaaactctctagctagagggaacttagggaaaacggaattccacgtgtagcggtgaaatgcgtagatatgtggaagaacaccggtggtgaagacggttttctagggttcctgacgctgaggcgcgaaagctaggggagcaaacagg

SEQ ID NO: 439 - DNA, 254 bp, Unknown
  Kingdom: Bacteria, Phylum: Chloroflexi, Class: Anaerolineae, Order: Anaerolineales, Family: Anaerolineaceae, Genus:
aaacgtaggaggcaagcgttatccggagttactgggcgtaaagcgcgtgcaggtggttgagtaagttggttatgaaagctcctggctaaactgggagaggttgaccaagactgctgaacttgagtggatgagaggtaaacggaattccgcgtgtagtggtgaaatgcgtagagatgcggaggaacaccagtggcgaaggcggtttactggcatccaactgacactgagacgcgaaagcatgggtagcgaacggg

SEQ ID NO: 440 - DNA, 254 bp, Unknown
  Kingdom: Bacteria, Phylum: Chloroflexi, Class: Anaerolineae, Order: Anaerolineales, Family: Anaerolineaceae, Genus:
aaacgtaggagacaaacgttatccggagttactgggcgtaaagggcgtgtaggcggttggttaagtctggcgtgaaagctctcggctaaaccgggagaggtcgttggatactggccaactagaggatggtagaggcgtgtggaattccgggtgtagtggtgaaatgcgtagagatccggaggaacaccagtggcgaaggcgacacgctgggccatacctgacgctaaagcgcgacagcatggggagcaaacggg

SEQ ID NO: 441 - DNA, 254 bp, Unknown
  Kingdom: Bacteria, Phylum: Chloroflexi, Class: Anaerolineae, Order: Anaerolineales, Family: Anaerolineaceae, Genus:
aaacgtaggagacgaacgttatccggagttactgggcgtaaagggcgtgtaggcggtatgttaagtctggcgtgaaagctctcggctaaaccgggagaggtcgtcggatactggcaaactagaggatggtagaggcgtgtggaattccgggtgtagtggtgaaatgcgtagagatccggaggaacaccagtggcgaaggcgacacgctgggccatacctgacgctaaagcgcgacagcatggggagcaaacggg

SEQ ID NO: 442 - DNA, 254 bp, Unknown
  Kingdom: Bacteria, Phylum: Chloroflexi, Class: Anaerolineae, Order: Anaerolineales, Family: Anaerolineaceae, Genus:
aaacgtaggaggcaagcgttatccggagtaactgggcgtaaagggcgagtaggtggttttgtaagttggttatgaaagctcctggctaaactgggagaggttgaccaagactgcaagacttgagtggagaagaggtaaacggaattccgcgtgtagtggtgaaatgcgtagagatgcggaagaacaccagtggcgaaggcggtttactggtctccaactgacactgaaccgcgaaagcatgggtagcgaacggg

SEQ ID NO: 443 - DNA, 255 bp, Unknown
  Kingdom: Bacteria, Phylum: Chloroflexi, Class: Anaerolineae, Order: Anaerolineales, Family: Anaerolineaceae, Genus:
aaacgtaggaggcgagcgttacccggagttactgggcgtaaagcgcgtgtaggtggttggatacgtctgctgtgaaatgtcccggcttaaaccgggagggtgcggcagatacggtctgaccagagggcgacagaggagcgtagaattccgggtgtagtggtgaaatgcgtagagatccggaggaataccagtggcgcaagcggcgctctgggtcgcaactgacactgagacgcgaaggcatggggagcgaacggg

SEQ ID NO: 444 - DNA, 254 bp, Unknown
  Kingdom: Bacteria, Phylum: Chloroflexi, Class: Anaerolineae, Order: Anaerolineales, Family: Anaerolineaceae, Genus:
aaacgtaggacacaagcgttatccggagttactgggcgtaaagggcgtgtaggcggagttgtaagtctattctgaaagctcctggctaaactgggagaggcgaatggagactgcaaatctagagtgaggaagaggaaagtggaattccgcgtgtagtggtgaaatgcgtagagatgcggaggaacaccagtggcgaaagcgactttctggtccttaactgacgctgaggcgcgaaagcatggggagcgaacggg

SEQ ID NO: 445 - DNA, 251 bp, Unknown
  Kingdom: Bacteria, Phylum: Chloroflexi, Class: Anaerolineae, Order: SBR1031, Family: A4b, Genus:
cacgtaggacgcaagcgttatccggaattactgggcgtaaagagcgtgtaggcggtgctgtaagtcaaccgtgaaagctcccggctaaactgggagaggtcggatgagactgcagcgctagtgggtcgtagaggaatgtggaattccgggtgtagtggtgaaatgcgtagagatccggaggaacaccagaggcgaaggcggcattctggacgatcagacgctgagacgcgacagcacggggagcgaacggg

SEQ ID NO: 446 - DNA, 251 bp, Unknown
  Kingdom: Bacteria, Phylum: Chloroflexi, Class: Anaerolineae, Order: SBR1031, Family: A4b, Genus:
aacgtaggaggcaagcgttatccggagttactgggcgtaaagcgcgtgtaggtggattggtaagttacttatgaaagctcctggctaaactaggagaggttgagtgatactgccagtcttgaatagaggagaggttgacggaattccgcgtgtagtggtgaaatgcgtagagatgcggaagaacaccagtggcgaaggcggtcaactggcctcattgacactcagacgcgaaggcatgggtagcgaacggg

SEQ ID NO: 447 - DNA, 254 bp, Unknown
  Kingdom: Bacteria, Phylum: Chloroflexi, Class: Chloroflexia, Order: Chloroflexales, Family: Roseiflexaceae, Genus:
agacagaggagccaagcgttgtccggattgactgggcgtaaagcgcacgcaggcggacgcgcgcgtggggtgtgaaatctggccgcttaacggccaggcgccatcccatacggcgcgtctggagtgatgcagaggtcgatggaattgccggtgtagtggtgaaatgcgtagagatcggcaggaacacccagggggaaaccagtcgactgggcatctactgacgctgaggtgcgagagcgtggggagcgaaccgg

SEQ ID NO: 448 - DNA, 254 bp, Unknown
  Kingdom: Bacteria, Phylum: Chloroflexi, Class: Chloroflexia, Order: Chloroflexales, Family: Roseiflexaceae, Genus:
atacagaggagccaagcgttgtccggattgactgggcgtaaagcgcacgcaggcggtctggcgcgtggggtgtgaaatctggccgcttaacggccaggcgccatcccatacggccggactggagggctgcagaggtcgatggaattgccggtgtagtggtgaaatgcgtagagatcggcaggaacacccagggggaaaccagtcgactgggcagcacctgacgctgaggtgcgagagcgtggggagcgaaccgg

SEQ ID NO: 449 - DNA, 254 bp, Unknown
  Kingdom: Bacteria, Phylum: Chloroflexi, Class: KD4-96, Order:  , Family:  , Genus:
atacgtaggtggcaagcgttgtccggatttactgggcgtaaagagcgcgcaggcggtcgttcaagtcgcgtgtgaaagcccccggctcaactggggagggtcacgcgatactgatcgactcgaaggcaggagagggtagtggaattcccggtgtagtggtgaaatgcgtagatatcgggaggaacaccagtggcgaaggcgactacctggcctgttcttgacgctgaggcgcgaaagctaggggagcaaacggg

SEQ ID NO: 450 - DNA, 254 bp, Unknown
  Kingdom: Bacteria, Phylum: Chloroflexi, Class: Thermomicrobia, Order: JG30-KF-CM45, Family:  , Genus:
atacgtagggtccgagcgttgtccggagttactgggcgtaaagcgcgcgcaggcggcggtgctggcccggcgtgaaagcccccggctcaaccggggagggtcgtcggggaccgcaccgcttgagggcggtaggggctggtggaatgcctggtgtagtggtgaaatgcgtagagatcaggcggaacacctgtggcgaaggcggccagctgggccgtccctgacgctgaggcgcgaaggcgtggggagcgaacggg

SEQ ID NO: 451 - DNA, 254 bp, Unknown
  Kingdom: Bacteria, Phylum: Chloroflexi, Class: Thermomicrobia, Order: JG30-KF-CM45, Family:  , Genus:
atacgtaggggtcgagcgttgtccggagttactgggcgtaaagcgcatgcaggcggctcattacgcatggcgtgaaagcccccggctcaaccggggagggtcgtcgtgaacgggtgagcttgagggtatcaggggctggtggaattcccggtgtagtggtgaaatgcgtagagatcgggaggaacacctgtggcgaaggcggccagctgggatacacctgacgctgagatgcgaaggcgtggggagcgaacggg

SEQ ID NO: 452 - DNA, 251 bp, Unknown
  Kingdom: Bacteria, Phylum: Chloroflexi, Class: TK10, Order: B07_WMSP1, Family:  , Genus:
tacgtagggtgcaagcgttgcccggatttattgggcgtaaagggcgcgtaggcggctctgcacgttcgttgtgaaatcgcccggctcaactgggcggggtcagcggatacggcagagcttgagcaagctagggggcaatggaattcccggtgtagtggtggaatgcgtagatatcgggaggaacaccagtggcgaaggcggttgcctggggctgctgacgctgatgcgcgaaagcgtggggagcgatccgg

SEQ ID NO: 453 - DNA, 254 bp, Unknown
  Kingdom: Bacteria, Phylum: Chloroflexi, Class: TK10, Order:  , Family:  , Genus:
atacgtagggtgcgagcgttgcccggatttattgggcgtaaagggcgcgcaggcggctacgcacgtccgttgtgaaatcgctcggctcaactgggcggggtcagcggatacggcgtggcttgagcaagctagggggcaatggaattcccggtgtagtggtggaatgcgtagatatcgggaggaacaccagtggcgaaggcggttgcctggagctttgctgacgctgaggcgcgaaagcgtggggagcgatccgg

SEQ ID NO: 454 - DNA, 252 bp, Unknown
  Kingdom: Bacteria, Phylum: Cyanobacteria, Class: Cyanobacteria, Order: SubsectionIII, Family: FamilyI, Genus: Arthronema
atacggaggatgcaagcgttatccggaattattgggcgtaaagggtccgcaggtggttgaacaagtctgctgtcaaagcgcggagcttaactccgtacgggcggtggaaactgtttaactggagtacggtaggggtagcgggaattcccagtgtagcggtgaatgagtagtattgggaagaacaccagcggcgaaagcgcgctactgggcctgtactgacactgagggacgaaagctaggggagcgaaaggg

SEQ ID NO: 455 - DNA, 254 bp, Unknown
  Kingdom: Bacteria, Phylum: Cyanobacteria, Class: Cyanobacteria, Order: SubsectionIII, Family: FamilyI, Genus:
agacggaggatgcaagcgttatccggaatgattgggcgtaaagcgtccgcaggtggcagttcaagtctgctgtcaaagaccggggcttaacttcggaaaggcagtggaaactgaacagctagagtatggtaggggcagagggaattcctggtgtagcggtgaaatgcgtagagatcaggaagaacatcggtggcgaaggcgctctgctggaccataactgacactcagggacgaaagctaggggagcgaatggg

SEQ ID NO: 456 - DNA, 254 bp, Unknown
  Kingdom: Bacteria, Phylum: Cyanobacteria, Class: Cyanobacteria, Order:  , Family:  , Genus:
atacggaggatgcaagcgttatccggaatgattgggcgtaaagcgtccgcaggtggcagtgtaagtctgctgtcaaaggtcagggcttaaccctgaacaggcagtggaaactacacagctagagtgcggtgggggcagagggaattcccagtgtagcggtgaaatgcgtagagattgggaagaacaccggtggcgaaagcgctctgctaggccgtaactgacactcatggacgaaagctaggggagcgaatggg

SEQ ID NO: 457 - DNA, 254 bp, Unknown
  Kingdom: Bacteria, Phylum: Cyanobacteria, Class: Melainabacteria, Order: Obscuribacterales, Family:  , Genus:
agacgtaggatgcgagcgttgtccggatttattgggcgtaaagagttcgtaggtggtttgtcaagtctgatgttaaagatcggggctcaaccctgggactgcattggatactggcagacttgagtgtggtagaggctagtggaattcccagtgtagcggtgaaatgcgtagatattgggaagaacaccggtggcgtaggcgactagctgggccataactgacactgaggaacgaaagccagggtagcgaatggg

SEQ ID NO: 458 - DNA, 254 bp, Unknown
  Kingdom: Bacteria, Phylum: Deinococcus-Thermus, Class: Deinococci, Order: Deinococcales, Family: Deinococcaceae, Genus:
atacggagggtgcaagcgttacccggaatcactgggcgtaaagggcgtgtaggcgggaacttaagtctggttttaaagaccggggctcaacctcggggatggactggatactgggtttcttgatctctggagaggtaaccggaattcctggtgtagcggtggaatgcgtagataccaggaggaacaccaatggcgaaggcaggttactggacagaagatgacgctgaggcgcgaaagtgtggggagcgaaccgg

SEQ ID NO: 459 - DNA, 251 bp, Unknown
  Kingdom: Bacteria, Phylum: Fibrobacteres, Class: Fibrobacteria, Order: 258ds10, Family:  , Genus:
tacgaggggggcaagtgttgttcggaatcactgggcgtaaagggagcgtgggcggatgtttaagttggaggtttaaaaccggggcccaacctcggagcggcctccaaaactggacgtcttgaatggaacagaggctagtggaatagggggtgtagcggtggaatgcgtagagatcccctagaacaccaattgcgaaggcagctagctgggttcattgacgctgaggctcgaaagcatggggagcaaacagg

SEQ ID NO: 460 - DNA, 251 bp, Unknown
  Kingdom: Bacteria, Phylum: Fibrobacteres, Class: Fibrobacteria, Order: 258ds10, Family:  , Genus:
tacgaggggggcaaatgttgttcggaatcactgggcgtaaagggagcgtaggcgggttcttaagttaggtgtttaatcccggggcccaaccccggaccggcacttaaaactgggaatcttgaatagtggagaggtcggtggaattgggggtgtagcggtggaatgcgtagagatccccaagaacaccagttgcgaaggcggccgactggacacattgacgctgaggctcgaaagcatggggagcaaacagg

SEQ ID NO: 461 - DNA, 251 bp, Unknown
  Kingdom: Bacteria, Phylum: Fibrobacteres, Class: Fibrobacteria, Order: 258ds10, Family:  , Genus:
tacgaggggggcaaatgttgttcggaatcactgggcgtaaagggagcgtaggcgggtttctaagtaaggtgtttaatcccggggcccaaccccggacaggcactttaaactggaagtcttgaatagtggagaggtcagtggaattgggggtgtagcggtggaatgcgtagagatccccaagaacaccagttgcgaaggcggctgactggacacattgacgctgagactcgaaagcatggggagcaaacagg

SEQ ID NO: 462 - DNA, 254 bp, Unknown
  Kingdom: Bacteria, Phylum: Fibrobacteres, Class: Fibrobacteria, Order: Fibrobacterales, Family: Fibrobacteraceae, Genus:
atacgaggggggcaaatgttgttcggaatcactgggcgtaaagggagcgtaggcgggttcttaagtaaggtgtttaatcccggggcccaaccccggaccggcattttaaactgggaatcttgaatagtggagaggtcggtggaattggaggtgtagcggtggaatgcgtagagatctccaagaacaccagttgcgaaggcggccgactggacacatattgacgctgaggctcgaaagcatggggagcaaacagg

SEQ ID NO: 463 - DNA, 254 bp, Unknown
  Kingdom: Bacteria, Phylum: Fibrobacteres, Class: Fibrobacteria, Order: Fibrobacterales, Family: Fibrobacteraceae, Genus:
atacgaggggggcaaatgttgttcggaatcactgggcgtaaagggagcgtaggcgggcttctaagttaggtgtttaatcccggggcccaaccccggacaggcacctaaaactggaagtcttgaatagtggagaggtcggcggaattgggggtgtagcggtggaatgcgtagagatccccaagaacaccagttgcgaaggcggccgactggacacatattgacgctgaggctcgaaagcatggggagcaaacagg

SEQ ID NO: 464 - DNA, 254 bp, Unknown
  Kingdom: Bacteria, Phylum: Fibrobacteres, Class: Fibrobacteria, Order: Fibrobacterales, Family: Fibrobacteraceae, Genus:
atacgaggggggcaagtgttgttcggaatcactgggcgtaaagggagcgtaggcggatgtttaagtcgggagtttaaaaccggggcccaaccccggagcggctcccgaaactgggcatcttgaataggtcagaggctggtggaattggaggtgtagcggtggaatgcgtagagatctccaagaacacctattgcgaaggcagccagctgggaccatattgacgctgaggctcgaaagcatggggagcaaacagg

SEQ ID NO: 465 - DNA, 254 bp, Unknown
  Kingdom: Bacteria, Phylum: Fibrobacteres, Class: Fibrobacteria, Order: Fibrobacterales, Family: Fibrobacteraceae, Genus:
atacgaggggggcaaatgttgttcggaatcactgggcgtaaagggagcgtaggcgggctcttaagttaggtgtttaatcccggggcccaaccccggacaggcacctaaaactgggagtcttgaatagtggagaggacggcggaattgggggtgtagcggtggaatgcgtagagatccccaagaacaccagttgcgaaggcggccgtctggacacatattgacgctgaggctcgaaagcatggggagcaaacagg

SEQ ID NO: 466 - DNA, 254 bp, Unknown
  Kingdom: Bacteria, Phylum: Firmicutes, Class: Bacilli, Order: Bacillales, Family: Alicyclobacillaceae, Genus:
atacgtagggggcaagcgttgtccggaatcactgggcgtaaagcgcgcgcaggcggctgtctacgtccggggtgaaagcccagagctcaactctgggactgccttggatacgggatggcttgaggatcggagaggcaaggggaattccacgtgtagcggtgaaatgcgtagagatgtggaggaacacctgtggcgaaggcgccttgctggccgatttctgacgctgaggcgcgaaagcgtggggagcaaacagg

SEQ ID NO: 467 - DNA, 254 bp, Unknown
  Kingdom: Bacteria, Phylum: Firmicutes, Class: Bacilli, Order: Bacillales, Family: Alicyclobacillaceae, Genus:
atacgtagggggcaagcgttgtccggattcactgggcgtaaagcgcgcgcaggcggtgatgtaagtctgaggtgaaaacccgaagctcaacttcgggactgccttggatactgcgtcacttgaggataggagaggcaaggggaattccacgtgtagcggtgaaatgcgtagagatgtggaggaacacctgtggcgaaggcgccttgctggcctatttctgacgctgaggcgcgaaagcgtggggagcaaacagg

SEQ ID NO: 468 - DNA, 254 bp, Unknown
  Kingdom: Bacteria, Phylum: Firmicutes, Class: Bacilli, Order: Bacillales, Family: Bacillaceae, Genus: Bacillus
atacgtaggtggcaagcgttgtccggaattattgggcgtaaagcgcgcgcaggcggtcttttaagtctgatgtgaaagcccacggctcaaccgtggagggtcattggaaactgggagacttgagtgcagaagaggagagtggaattccacgtgtagcggtgaaatgcgtagagatgtggaggaacaccagtggcgaaggcgactctctggtctgtaactgacgctgaggcgcgaaagcgtggggagcaaacagg

SEQ ID NO: 469 - DNA, 254 bp, Unknown
  Kingdom: Bacteria, Phylum: Firmicutes, Class: Bacilli, Order: Bacillales, Family: Bacillaceae, Genus:
atacgtaggtggcaagcgttgtccggaattattgggcgtaaagcgcgcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacagg

SEQ ID NO: 470 - DNA, 254 bp, Unknown
  Kingdom: Bacteria, Phylum: Firmicutes, Class: Bacilli, Order: Bacillales, Family: Bacillaceae, Genus:
atacgtaggtggcaagcgttgtccggaattattgggcgtaaagcgcgcgcaggcggcttcttaagtctgatgtgaaatcttgcggctcaaccgcaagcggtcattggaaactgggaggcttgagtgcagaagaggagagtggaattccacgtgtagcggtgaaatgcgtagagatgtggaggaacaccagtggcgaaggcggctctctggtctgtaactgacgctgaggcgcgaaagcgtggggagcaaacagg

SEQ ID NO: 471 - DNA, 254 bp, Unknown
  Kingdom: Bacteria, Phylum: Firmicutes, Class: Bacilli, Order: Bacillales, Family: Bacillaceae, Genus:
atacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacagg

SEQ ID NO: 472 - DNA, 254 bp, Unknown
  Kingdom: Bacteria, Phylum: Firmicutes, Class: Bacilli, Order: Bacillales, Family: Bacillaceae, Genus:
atacgtaggtggcaagcgttgtccggaattattgggcgtaaagcgcgcgcaggcggttccttaagtctgatgtgaaagcccccggctcaaccggggagggtcattggaaactggggaacttgagtgcagaagagaagagtggaattccacgtgtagcggtgaaatgcgtagagatgtggaggaacaccagtggcgaaggcgactctttggtctgtaactgacgctgaggcgcgaaagcgtggggagcaaacagg

SEQ ID NO: 473 - DNA, 254 bp, Unknown
  Kingdom: Bacteria, Phylum: Firmicutes, Class: Bacilli, Order: Bacillales, Family: Bacillaceae, Genus:
atacgtaggtggcaagcgttgtccggaattattgggcgtaaagcgcgcgcaggcggtcctttaagtctgatgtgaaagcccacggctcaaccgtggagggtcattggaaactgggggacttgagtacagaagaggaaagcggaattccacgtgtagcggtgaaatgcgtagagatgtggaggaacaccagtggcgaaggcggctttctggtctgtaactgacgctgaggcgcgaaagcgtggggagcaaacagg

SEQ ID NO: 474 - DNA, 254 bp, Unknown
  Kingdom: Bacteria, Phylum: Firmicutes, Class: Bacilli, Order: Bacillales, Family: Bacillaceae, Genus:
atacgtaggtggcaagcgttatccggaattattgggcgtaaagcgcgcgcaggcggtttcttaagtctgatgtgaaagcccacggctcaaccgtggagggtcattggaaactgggaaacttgagtgcagaagagaaaagcggaattccacgtgtagcggtgaaatgcgtagagatgtggaggaacaccagtggcgaaggcggctttttggtctgtaactgacgctgaggcgcgaaagcgtggggagcaaacagg

SEQ ID NO: 475 - DNA, 254 bp, Unknown
  Kingdom: Bacteria, Phylum: Firmicutes, Class: Bacilli, Order: Bacillales, Family: Bacillaceae, Genus:
atacgtaggtggcaagcgttgtccggaattattgggcgtaaagcgcgcgcaggcggtcctttaagtctgatgtgaaagcccacggctcaaccgtggagggtcattggaaactgggggacttgagtgcagaagaggagagcggaattccacgtgtagcggtgaaatgcgtagagatgtggaggaacaccagtggcgaaggcggctctctggtctgtaactgacgctgaggcgcgaaagcgtggggagcaaacagg

SEQ ID NO: 476 - DNA, 254 bp, Unknown
  Kingdom: Bacteria, Phylum: Firmicutes, Class: Bacilli, Order: Bacillales, Family: Bacillaceae, Genus:
atacgtaggtggcaagcgttgtccggaattattgggcgtaaagcgcgcgcaggtggttccttaagtctgatgtgaaagcccacggctcaaccgtggagggtcattggaaactggggaacttgagtgcagaagaggaaagtggaattccaagtgtagcggtgaaatgcgtagagatttggaggaacaccagtggcgaaggcgactttctggtctgtaactgacactgaggcgcgaaagcgtggggagcaaacagg

SEQ ID NO: 477 - DNA, 254 bp, Unknown
  Kingdom: Bacteria, Phylum: Firmicutes, Class: Bacilli, Order: Bacillales, Family: Bacillaceae, Genus:
atacgtagggggcgagcgttgtccggaattattgggcgtaaagcgcgcgcaggcggtctcttaagtctgatgtgaaagcccacggctcaaccgtggagggtcattggaaactgggggacttgagggcaggagaggagagcggaattccacgtgtagcggtgaaatgcgtagagatgtggaggaacaccagtggcgaaggcggctctctggcctgcacctgacgctgaggcgcgaaagcgtggggagcaaacagg

SEQ ID NO: 478 - DNA, 254 bp, Unknown
  Kingdom: Bacteria, Phylum: Firmicutes, Class: Bacilli, Order: Bacillales, Family: Bacillaceae, Genus:
atacgtaggtggcaagcgttatccggaattattgggcgtaaagcgcgcgcaggcggtttcttaagtctgatgtgaaagcccacggctcaaccgtggagggtcattggaaactggggaacttgagtgcagaagagaaaagcggaattccacgtgtagcggtgaaatgcgtagagatgtggaggaacaccagtggcgaaggcggctttttggtctgtaactgacgctgaggcgcgaaagcgtggggagcaaacagg

SEQ ID NO: 479 - DNA, 254 bp, Unknown
  Kingdom: Bacteria, Phylum: Firmicutes, Class: Bacilli, Order: Bacillales, Family: Bacillaceae, Genus:
atacgtagggggcaagcgttgtccggaattattgggcgtaaagggcgcgtaggcggtttcttaagtctgatgtgaaagcccacagcttaactgtggagggtcattggaaactggggaacttgagtgcagaagaggagagtggaattccacgtgtagcggtgaaatgcgtagatatgtggaggaacaccagtggcgaaggcgactctctggtctgtaactgacgctgaggcgcgaaagcgtggggagcaaacagg

SEQ ID NO: 480 - DNA, 254 bp, Unknown
  Kingdom: Bacteria, Phylum: Firmicutes, Class: Bacilli, Order: Bacillales, Family: Bacillaceae, Genus:
atacgtaggtggcaagcgttgtccggaattattgggcgtaaagggctcgcaggcggttccttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacagg

SEQ ID NO: 481 - DNA, 254 bp, Unknown
  Kingdom: Bacteria, Phylum: Firmicutes, Class: Bacilli, Order: Bacillales, Family: Bacillaceae, Genus:
atacgtaggtggcaagcgttatccggaattattgggcgtaaagcgcgcgcaggcggtttcttaagtctgatgtgaaagcccacggctcaaccgtggagggtcattggaaactggggaacctgagtgcagaagagaaaagcggaattccacgtgtagcggtgaaatgcgtagagatgtggaggaacaccagtggcgaaggcggctttttggtctgtaactgacgctgaggcgcgaaagcgtggggagcaaacagg

SEQ ID NO: 482 - DNA, 254 bp, Unknown
  Kingdom: Bacteria, Phylum: Firmicutes, Class: Bacilli, Order: Bacillales, Family: Bacillaceae, Genus:
atacgtagggggcaagcgttgtccggaattattgggcgtaaagggctcgtaggcggtttcttaagtctgatgtgaaagcccacagctcaactgtggagggtcattggaaactggggaacttgagtgcagaagaggagagtggaattccacgtgtagcggtgaaatgcgtagatatgtggaggaacaccagtggcgaaggcgactctctggtctgtaactgacgctgaggagcgaaagcgtggggagcaaacagg

SEQ ID NO: 483 - DNA, 254 bp, Unknown
  Kingdom: Bacteria, Phylum: Firmicutes, Class: Bacilli, Order: Bacillales, Family: Bacillaceae, Genus:
atacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacagg

SEQ ID NO: 484 - DNA, 251 bp, Unknown
  Kingdom: Bacteria, Phylum: Firmicutes, Class: Bacilli, Order: Bacillales, Family: Bacillaceae, Genus:
tacgtaggtggcaagcgttgtccggaattattgggcgtaaagggctcgcaggcggttccttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctgggctgactgacgctgaggcgcgaaagcgtggggagcaaacagg

SEQ ID NO: 485 - DNA, 254 bp, Unknown
  Kingdom: Bacteria, Phylum: Firmicutes, Class: Bacilli, Order: Bacillales, Family: Bacillaceae, Genus:
atacgtaggtggcaagcgttgtccggaattattgggcgtaaagcgcgcgcaggcggtcctttaagtctgatgtgaaagcccacggctcaaccgtggagggtcattggaaactgggggacttgagtgcaggagagaagagtggaattccacgtgtagcggtgaaatgcgtagagatgtggaggaacaccagtggcgaaggcgactctttggcctgtaactgacgctgaggcgcgaaagcgtggggagcaaacagg

SEQ ID NO: 486 - DNA, 254 bp, Unknown
  Kingdom: Bacteria, Phylum: Firmicutes, Class: Bacilli, Order: Bacillales, Family: Bacillaceae, Genus:
atacgtaggtggcaagcgttgtccggaattattgggcgtaaagcgcgcgcaggcggtcctttaagtctgatgtgaaagcccacggctcaaccgtggagggtcattggaaactgggagacttgagtacagaagagaagagtggaattccacgtgtagcggtgaaatgcgtagagatgtggaggaacaccagtggcgaaggcgactctttggtctgtaactgacgctgaggcgcgaaagcgtggggagcaaacagg

SEQ ID NO: 487 - DNA, 254 bp, Unknown
  Kingdom: Bacteria, Phylum: Firmicutes, Class: Bacilli, Order: Bacillales, Family: Bacillaceae, Genus:
atacgtaggtggcaagcgttgtccggaattattgggcgtaaagcgcgcgcaggcggttccttaagtctgatgtgaaagcccacggctcaaccgtggagggtcattggaaactggggaacttgagtgcagaagaggagagcggaattccacgtgtagcggtgaaatgcgtagagatgtggaggaacaccagtggcgaaggcggctctctggtctgtaactgacgctgaggcgcgaaagcgtggggagcaaacagg

SEQ ID NO: 488 - DNA, 254 bp, Unknown
  Kingdom: Bacteria, Phylum: Firmicutes, Class: Bacilli, Order: Bacillales, Family: Bacillaceae, Genus:
atacgtaggtggcaagcgttgtccggaattattgggcgtaaagcgcgcgcaggcggttccttaagtctgatgtgaaagcccacggctcaaccgtggagggtcattggaaactggggaacttgagtgcagaagagaagagcggaattccacgtgtagcggtgaaatgcgtagagatgtggaggaacaccagtggcgaaggcggctctttggtctgtaactgacgctgaggcgcgaaagcgtggggagcaaacagg

SEQ ID NO: 489 - DNA, 254 bp, Unknown
  Kingdom: Bacteria, Phylum: Firmicutes, Class: Bacilli, Order: Bacillales, Family: Bacillaceae, Genus:
atacgtaggtggcaagcgttgtccggaattattgggcgtaaagcgcgcgcaggcggttccttaagtctgatgtgaaagcccacggctcaaccgtggagggtcattggaaactgggggacttgagtgcagaagaggagagcggaattccacgtgtagcggtgaaatgcgtagagatgtggaggaacaccagtggcgaaggcggctctctggtctgtaactgacgctgaggcgcgaaagcgtggggagcaaacagg

SEQ ID NO: 490 - DNA, 254 bp, Unknown
  Kingdom: Bacteria, Phylum: Firmicutes, Class: Bacilli, Order: Bacillales, Family: Bacillaceae, Genus:
atacgtagggggcaagcgttgtccggaattattgggcgtaaagcgcgcgcaggcggtcctttaagtctgatgtgaaagcccacggctcaaccgtggagggtcattggaaactggaggacttgagtacagaagaggagagtggaattccacgtgtagcggtgaaatgcgtagagatgtggaggaacaccagtggcgaaggcgactctctggtctgtaactgacgctgaggcgcgaaagcgtggggagcgaacagg

SEQ ID NO: 491 - DNA, 254 bp, Unknown
  Kingdom: Bacteria, Phylum: Firmicutes, Class: Bacilli, Order: Bacillales, Family: Bacillaceae, Genus:
atacgtaggtggcaagcgttgtccggaattattgggcgtaaagcgcgcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggcgcgaaagcgtggggagcaaacagg

SEQ ID NO: 492 - DNA, 254 bp, Unknown
  Kingdom: Bacteria, Phylum: Firmicutes, Class: Bacilli, Order: Bacillales, Family: Bacillaceae, Genus:
atacgtaggtggcaagcgttgtccggaattattgggcgtaaagcgcgcgcaggcggtcttttaagtctgatgtgaaagcccacggctcaaccgtggagggtcattggaaactgggagacttgagtgcagaagagaagagtggaattccacgtgtagcggtgaaatgcgtagagatgtggaggaacaccagtggcgaaggcgactctttggtctgtaactgacgctgaggcgcgaaagcgtggggagcaaacagg

SEQ ID NO: 493 - DNA, 253 bp, Unknown
  Kingdom: Bacteria, Phylum: Firmicutes, Class: Bacilli, Order: Bacillales, Family: Bacillaceae, Genus:
tacgtaggtggcaagcgttgtccggaattattgggcgtaaagcgcgcgcaggcggttccttaagtctgatgtgaaagcccccggctcaaccggggggggtcattggaaactggggaacttgagtgcagaagagaagagtggaattccacgtgtagcggtgaaatgcgtagagatgtggaggaacaccagtggcgaaggcgactctttgggctgtaactgacgctgaggcgcgaaagcgtggggagcaaacagg

SEQ ID NO: 494 - DNA, 254 bp, Unknown
  Kingdom: Bacteria, Phylum: Firmicutes, Class: Bacilli, Order: Bacillales, Family: Bacillaceae, Genus:
atacgtaggtggcaagcgttgtccggaattattgggcgtaaagcgcgcgcaggcggtcctttaagtctgatgtgaaggcccacggctcaaccgtggagggtcattggaaactgggggacttgagtgcagaagagaagagtggaattccacgtgtagcggtgaaatgcgtagagatgtggaggaacaccagtggcgaaggcgactctttggtctgtaactgacgctgaggcgcgaaagcgtggggagcaaacagg

SEQ ID NO: 495 - DNA, 254 bp, Unknown
  Kingdom: Bacteria, Phylum: Firmicutes, Class: Bacilli, Order: Bacillales, Family: Bacillaceae, Genus:
atacgtaggtggcaagcgttatccggaattattgggcgtaaagcgcgcgcaggtggtttcttaagtctgatgtgaaagcccacggctcaaccgtggagggtcattggaaactgggagacttgagtgcagaagaggaaagtggaattccatgtgtagcggtgaaatgcgtagagatatggaggaacaccagtggcgaaggcgactttctggtctgtaactgacactgaggcgcgaaagcgtggggagcaaacagg

SEQ ID NO: 496 - DNA, 254 bp, Unknown
  Kingdom: Bacteria, Phylum: Firmicutes, Class: Bacilli, Order: Bacillales, Family: Bacillaceae, Genus:
atacgtaggtggcaagcgttgtccggaattattgggcgtaaagcgcgcgcaggcggtcctttaagtctgatgtgaaagcccacggctcaaccgtggagggtcattggaaactgggggacttgagtgcagaagaggaaagcggaattccacgtgtagcggtgaaatgcgtagagatgtggaggaacaccagtggcgaaggcggctttctggtctgtaactgacgctgaggcgcgaaagcgtggggagcaaacagg

SEQ ID NO: 497 - DNA, 254 bp, Unknown
  Kingdom: Bacteria, Phylum: Firmicutes, Class: Bacilli, Order: Bacillales, Family: Bacillaceae, Genus:
atacgtaggtggcaagcgttgtccggaattattgggcgtaaagcgcgcgcaggcggtcctttaagtctgatgtgaaagcccacggctcaaccgtggagggtcattggaaactgggggacttgagtgcagaagagaagagtggaattccacgtgtagcggtgaaatgcgtagagatgtggaggaacaccagtggcgaaggcgactctttggtctgtaactgacgctgaggcgcgaaagcgtggggagcaaacagg

SEQ ID NO: 498 - DNA, 254 bp, Unknown
  Kingdom: Bacteria, Phylum: Firmicutes, Class: Bacilli, Order: Bacillales, Family: Bacillaceae, Genus:
atacgtaggtggcaagcgttgtccggaattattgggcgtaaagcgcgcgcaggtggtctcttaagtctgatgtgaaagcccccggctcaaccggggagggtcattggaaactgggagacttgagtgcaggagagaagagtggaattccacgtgtagcggtgaaatgcgtagagatgtggaggaacaccagtggcgaaggcgactctttggcctgtaactgacactgaggcgcgaaagcgtggggagcaaacagg

SEQ ID NO: 499 - DNA, 254 bp, Unknown
  Kingdom: Bacteria, Phylum: Firmicutes, Class: Bacilli, Order: Bacillales, Family: Family_XII, Genus:
atacgtaggtggcaagcgttgtccggaattattgggcgtaaagcgcgcgcaggcggccttttaagtctgatgtgaaagcccccggctcaaccggggagggccattggaaactggaaggcttgagtacagaagagaagagtggaattccacgtgtagcggtgaaatgcgtagagatgtggaggaacaccagtggcgaaggcgactctttggtctgtaactgacgctgaggcgcgaaagcgtggggagcaaacagg

SEQ ID NO: 500 - DNA, 254 bp, Unknown
  Kingdom: Bacteria, Phylum: Firmicutes, Class: Bacilli, Order: Bacillales, Family: Family_XII, Genus:
atacgtaggtggcaagcgttgtccggaattattgggcgtaaagcgcgcgcaggcggccttttaagtctgatgtgaaagcccccggctcaaccggggagggtcattggaaactggaaggcttgagtacagaagagaagagtggaattccatgtgtagcggtgaaatgcgtagagatgtggaggaacaccagtggcgaaggcgactctttggtctgtaactgacgctgaggcgcgaaagcgtggggagcaaacagg

SEQ ID NO: 501 - DNA, 253 bp, Unknown
  Kingdom: Bacteria, Phylum: Firmicutes, Class: Bacilli, Order: Bacillales, Family: Paenibacillaceae, Genus:
atacgtagggggcaagcgttgtccggaattattgggcgtaaagcgcgcgcaggcggtcatttaagtctggtgtttaatcccggggctcaaccccggatcgcactggaaactggatgacttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacagg

SEQ ID NO: 502 - DNA, 253 bp, Unknown
  Kingdom: Bacteria, Phylum: Firmicutes, Class: Bacilli, Order: Bacillales, Family: Paenibacillaceae, Genus:
atacgtagggggcaagcgttgtccggaattattgggcgtaaagcgcgcgcaggcggttatttaagtttggtgtttaagcccggggctcaaccccggatcgcactgaaaactggatgacttgagtgcgggagaggaaagtggaattccacgtgtagcggtgaaatgcgtagagatgtggaggaacaccagtggcgaaggcgactttctggaccgtaactgacgctgaggcgcgaaagcgtggggagcaaacagg

SEQ ID NO: 503 - DNA, 250 bp, Unknown
  Kingdom: Bacteria, Phylum: Firmicutes, Class: Bacilli, Order: Bacillales, Family: Paenibacillaceae, Genus:
tacgtagggggcaagcgttgtccggaattattgggcgtaaagcgcgcgcaggcggtcatttaagtctggtgtttaatcctggggctcaaccccagttcgcatcggaaactggatgacttgagtgtaagagaggaaagtggaattccacgtgtagcggtgaaatgcgtagagatgtggaggaacaccagtggcgaaggcgactttctggcttaactgacgctgaggcgcgaaagcgtggggagcaaacagg

SEQ ID NO: 504 - DNA, 253 bp, Unknown
  Kingdom: Bacteria, Phylum: Firmicutes, Class: Bacilli, Order: Bacillales, Family: Paenibacillaceae, Genus:
atacgtagggggcaagcgttgtccggaattattgggcgtaaagcgcgtgcaggcggcttcttaagttgggtgtttaagaccggggctcaaccccggctcgcacccaaaactgggaagcttgagtgtaggagaggaaagtggaattccacgtgtagcggtgaaatgcgtagagatgtggaggaacaccagtggcgaaggcgactttctggcctataactgacgctgaggcgcgaaagcgtggggagcaaacagg

SEQ ID NO: 505 - DNA, 253 bp, Unknown
  Kingdom: Bacteria, Phylum: Firmicutes, Class: Bacilli, Order: Bacillales, Family: Paenibacillaceae, Genus:
atacgtagggggcaagcgttgtccggaattattgggcgtaaagcgcgcgcaggcggtcatgtaagtctggtgtttaatcccggggctcaaccccggatcgcactggaaactgcgtgacttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacagg

SEQ ID NO: 506 - DNA, 250 bp, Unknown
  Kingdom: Bacteria, Phylum: Firmicutes, Class: Bacilli, Order: Bacillales, Family: Paenibacillaceae, Genus:
tacgtagggggcaagcgttgtccggaattattgggcgtaaagcgcgcgcaggcggttaattaagttgggtgtttaagcccggggctcaaccccggttcgcatccaaaactggttgacttgagtgtaggagaggaaagtggaattccacgtgtagcggtgaaatgcgtagagatgtggaggaacaccagtggcgaaggcgactttctggcctaactgacgctgaggcgcgaaagcgtggggagcaaacagg

SEQ ID NO: 507 - DNA, 253 bp, Unknown
  Kingdom: Bacteria, Phylum: Firmicutes, Class: Bacilli, Order: Bacillales, Family: Paenibacillaceae, Genus:
atacgtagggggcaagcgttgtccggaattattgggcgtaaagcgcgcgcaggcggctatttaagtctggtgtttaaaccttgggctcaacctgaggtcgcactggaaactgggtggcttgagtacagaagaggaaagtggaattccacgtgtagcggtgaaatgcgtagagatgtggaggaacaccagtggcgaaggcgactttctgggctgtaactgacgctgaggcgcgaaagcgtggggagcaaacagg

SEQ ID NO: 508 - DNA, 250 bp, Unknown
  Kingdom: Bacteria, Phylum: Firmicutes, Class: Bacilli, Order: Bacillales, Family: Paenibacillaceae, Genus:
tacgtagggggcaagcgttgtccggaattattgggcgtaaagcgcgcgcaggcggtcatgtaagtctggtgtttaatcccggggctcaaccccggatcgcactggaaactgcgtgacttgagtgcagaagaggagagtggaattccacgtgtagcggtgaaatgcgtagagatgtggaggaacaccagtggcgaaggcgactctctgggctgactgacgctgaggcgcgaaagcgtggggagcaaacagg

SEQ ID NO: 509 - DNA, 253 bp, Unknown
  Kingdom: Bacteria, Phylum: Firmicutes, Class: Bacilli, Order: Bacillales, Family: Paenibacillaceae, Genus:
atacgtagggggcaagcgttgtccggaattattgggcgtaaagcgcgcgcaggcggctatttaagtctggtgtttaaaccttgggctcaacctggggtcgcactggaaactgggtggcttgagtacagaagaggaaagtggaattccacgtgtagcggtgaaatgcgtagagatgtggaggaacaccagtggcgaaggcgactttctgggctgtaactgacgctgaggcgcgaaagcgtggggagcaaacagg

SEQ ID NO: 510 - DNA, 250 bp, Unknown
  Kingdom: Bacteria, Phylum: Firmicutes, Class: Bacilli, Order: Bacillales, Family: Paenibacillaceae, Genus:
tacgtagggggcaagcgttgtccggaattattgggcgtaaagcgcgcgcaggcggctttttaagtccggtgtcacagcccaaggctcaaccttgggtcgcactggaaactggagagcttgagtacagaagaggaaagtggaattccacgtgtagcggtgaaatgcgtagagatgtggaggaacaccagtggcgaaggcgactttctgggctgactgacgctgaggcgcgaaagcgtggggagcaaacagg

SEQ ID NO: 511 - DNA, 253 bp, Unknown
  Kingdom: Bacteria, Phylum: Firmicutes, Class: Bacilli, Order: Bacillales, Family: Paenibacillaceae, Genus:
atacgtagggggcaagcgttgtccggaattattgggcgtaaagcgcgcgcaggcggtcttttaagtctggtgtttaagcccggggctcaaccccggttcgcactggaaactgggagacttgagtgtaggagaggaaagtggaattccacgtgtagcggtgaaatgcgtagagatgtggaggaacaccagtggcgaaggcgactttctggcctataactgacgctgaggcgcgaaagcgtggggagcaaacagg

SEQ ID NO: 512 - DNA, 253 bp, Unknown
  Kingdom: Bacteria, Phylum: Firmicutes, Class: Bacilli, Order: Bacillales, Family: Paenibacillaceae, Genus:
atacgtagggggcaagcgttgtccggaattattgggcgtaaagcgcgcgcaggcggtcatgtaagtctggtgtttaatcccggggctcaaccccggatcgcactggaaactgtgtgacttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacagg

SEQ ID NO: 513 - DNA, 253 bp, Unknown
  Kingdom: Bacteria, Phylum: Firmicutes, Class: Bacilli, Order: Bacillales, Family: Paenibacillaceae, Genus:
atacgtagggggcaagcgttgtccggaattattgggcgtaaagcgcgcgcaggcggccttgtaagtctgttgtttaaactcggggctcaaccccgagtcgcaatggaaactgcaaagcttgagtacagaagaggaaagtggaattccacgtgtagcggtgaaatgcgtagagatgtggaggaacaccagtggcgaaggcgactttctgggctgtaactgacgctgaggcgcgaaagcgtggggagcaaacagg

SEQ ID NO: 514 - DNA, 253 bp, Unknown
  Kingdom: Bacteria, Phylum: Firmicutes, Class: Bacilli, Order: Bacillales, Family: Paenibacillaceae, Genus:
atacgtagggggcaagcgttgtccggaattattgggcgtaaagcgcgcgcaggcggctctttaagtctggtgtttaatcccgaggctcaacttcgggtcgcactggaaactggggagcttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacagg

SEQ ID NO: 515 - DNA, 253 bp, Unknown
  Kingdom: Bacteria, Phylum: Firmicutes, Class: Bacilli, Order: Bacillales, Family: Paenibacillaceae, Genus:
atacgtagggggcaagcgttgtccggaattattgggcgtaaagcgcgcgcaggcggtcatttaagtctggtgtttaatcctggggctcaaccccgggtcgcactggaaactgggtgacttgagtacagaagaggagagtggaattccacgtgtagcggtgaaatgcgtagatatgtggaggaacaccagtggcgaaggcgactctctgggctgtaactgacgctgaggcgcgaaagcgtggggagcaaacagg

SEQ ID NO: 516 - DNA, 253 bp, Unknown
  Kingdom: Bacteria, Phylum: Firmicutes, Class: Bacilli, Order: Bacillales, Family: Paenibacillaceae, Genus:
atacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagatatgtggaggaacaccagtggcgaaggcgactctctgggctgtaactgacgctgaggcgcgaaagcgtggggagcaaacagg

SEQ ID NO: 517 - DNA, 253 bp, Unknown
  Kingdom: Bacteria, Phylum: Firmicutes, Class: Bacilli, Order: Bacillales, Family: Paenibacillaceae, Genus:
atacgtagggggcaagcgttgtccggaattattgggcgtaaagcgcgtgcaggcggcttgttaagtcggatgtttaagatcggggctcaaccccgattcgcatccgaaactggcaagcttgagtgtaggagaggaaagtggaattccacgtgtagcggtgaaatgcgtagagatgtggaggaacaccagtggcgaaggcgactttctggcctataactgacgctgaggcgcgaaagcgtggggagcaaacagg

SEQ ID NO: 518 - DNA, 253 bp, Unknown
  Kingdom: Bacteria, Phylum: Firmicutes, Class: Bacilli, Order: Bacillales, Family: Paenibacillaceae, Genus:
atacgtagggggcaagcgttgtccggaattattgggcgtaaagcgcgcgcaggcggtcatttaagtctggtgtttaatcctggggctcaaccccagttcgcatcggaaactggatgacttgagtgtaggagaggaaagtggaattccacgtgtagcggtgaaatgcgtagagatgtggaggaacgccagtggcgaaggcgactttctggcctataactgacgctgaggcgcgaaagcgtggggagcaaacagg

SEQ ID NO: 519 - DNA, 253 bp, Unknown
  Kingdom: Bacteria, Phylum: Firmicutes, Class: Bacilli, Order: Bacillales, Family: Paenibacillaceae, Genus:
atacgtagggggcaagcgttgtccggaattattgggcgtaaagcgcgtgcaggcggcttcttaagtcgggtgtttaagaccggggctcaaccccggctcgcacccaaaactgggaagcttgagtgtaggagaggaaagtggaattccacgtgtagcggtgaaatgcgtagagatgtggaggaacaccagtggcgaaggcgactttctggcctataactgacgctgaggcgcgaaagcgtggggagcaaacagg

SEQ ID NO: 520 - DNA, 253 bp, Unknown
  Kingdom: Bacteria, Phylum: Firmicutes, Class: Bacilli, Order: Bacillales, Family: Paenibacillaceae, Genus:
atacgtagggggcaagcgttgtccggaattattgggcgtaaagcgcgcgcaggcggttaattaagtctggtgtttaagcccggggctcaaccccggttcgcatcggaaactggttgacttgagtgtaggagaggaaagtggaattccacgtgtagcggtgaaatgcgtagagatgtggaggaacaccagtggcgaaggcgactttctggcctataactgacgctgaggcgcgaaagcgtggggagcaaacagg

SEQ ID NO: 521 - DNA, 253 bp, Unknown
  Kingdom: Bacteria, Phylum: Firmicutes, Class: Bacilli, Order: Bacillales, Family: Paenibacillaceae, Genus:
atacgtaggtggcaagcgttgtccggaattattgggcgtaaagcgcgcgcaggcggctatgtaagtctggtgttaaagcccggggctcaaccccggttcgcatcggaaactgtgtagcttgagtgcagaagaggaaagcggtattccacgtgtagcggtgaaatgcgtagagatgtggaggaacaccagtggcgaaggcggctttctggtctgtaactgacgctgaggcgcgaaagcgtggggagcaaacagg

SEQ ID NO: 522 - DNA, 253 bp, Unknown
  Kingdom: Bacteria, Phylum: Firmicutes, Class: Bacilli, Order: Bacillales, Family: Paenibacillaceae, Genus:
atacgtagggggcaagcgttgtccggaattattgggcgtaaagcgcgcgcaggcggccgtttaagtccggtgtttaatcccgaagctcaacttcgggtcgcactggaaactggagggcttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacagg

SEQ ID NO: 523 - DNA, 253 bp, Unknown
  Kingdom: Bacteria, Phylum: Firmicutes, Class: Bacilli, Order: Bacillales, Family: Paenibacillaceae, Genus:
atacgtagggggcaagcgttgtccggaattattgggcgtaaagcgcgcgcaggcggcggtttaagtctggagtttaagcccggggctcaaccccggatcgctctggaaactggatcgcttgagtgcaggagagagaagcggaattccacgtgtagcggtgaaatgcgtagagatgtggaggaacaccagtggcgaaggcggcttcttggcctgtaactgacgctgaggcgcgaaagcgtggggagcaaacagg

SEQ ID NO: 524 - DNA, 253 bp, Unknown
  Kingdom: Bacteria, Phylum: Firmicutes, Class: Bacilli, Order: Bacillales, Family: Paenibacillaceae, Genus:
atacgtagggggcaagcgttgtccggaattattgggcgtaaagcgcgcgcaggcggctatttaagtctggtgtttaaaccttgggctcaacctggggtcgcactggaaactggatggcttgagtacagaagaggaaagtggaattccacgtgtagcggtgaaatgcgtagatatgtggaggaacaccagtggcgaaggcgactttctgggctgtaactgacgctgaggcgcgaaagcgtggggagcaaacagg

SEQ ID NO: 525 - DNA, 253 bp, Unknown
  Kingdom: Bacteria, Phylum: Firmicutes, Class: Bacilli, Order: Bacillales, Family: Paenibacillaceae, Genus:
atacgtagggggcaagcgttgtccggaattattgggcgtaaagcgcgcgcaggcggttcattaagttgggtgtttaagcccggggctcaaccccggttcgcatccaaaactggtgaacttgagtgtaggagaggaaagtggaattccacgtgtagcggtgaaatgcgtagagatgtggaggaacaccagtggcgaaggcgactttctggcctataactgacgctgaggcgcgaaagcgtggggagcaaacagg

SEQ ID NO: 526 - DNA, 253 bp, Unknown
  Kingdom: Bacteria, Phylum: Firmicutes, Class: Bacilli, Order: Bacillales, Family: Paenibacillaceae, Genus:
atacgtagggggcaagcgttgtccggaattattgggcgtaaagcgcgcgcaggcggctctttaagtctggtgtttaatcccgaggctcaacttcgggtcgcactggaaactggagagcttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacagg

SEQ ID NO: 527 - DNA, 253 bp, Unknown
  Kingdom: Bacteria, Phylum: Firmicutes, Class: Bacilli, Order: Bacillales, Family: Paenibacillaceae, Genus:
atacgtagggggcaagcgttgtccggaattattgggcgtaaagcgcgtgcaggcggcggattaagtcggatgtttaagatcggggctcaaccccgattcgcatccgaaactggcccgcttgagtgtaggagaggaaagtggaattccacgtgtagcggtgaaatgcgtagagatgtggaggaacaccagtggcgaaggcgactttctggcctataactgacgctgaggcgcgaaagcgtggggagcaaacagg

SEQ ID NO: 528 - DNA, 250 bp, Unknown
  Kingdom: Bacteria, Phylum: Firmicutes, Class: Bacilli, Order: Bacillales, Family: Paenibacillaceae, Genus:
tacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagagatgtggaggaacaccagtggcgaaggcgactctctgggctgactgacgctgaggcgcgaaagcgtggggagcaaacagg

SEQ ID NO: 529 - DNA, 253 bp, Unknown
  Kingdom: Bacteria, Phylum: Firmicutes, Class: Bacilli, Order: Bacillales, Family: Paenibacillaceae, Genus:
atacgtagggggcaagcgttgtccggaattattgggcgtaaagcgcgcgcaggcggtcaattaagttgggtgtttaagcccggggctcaaccccggttcgcatccaaaactggttgacttgagtgtaggagaggaaagtggaattccacgtgtagcggtgaaatgcgtagagatgtggaggaacaccagtggcgaaggcgactttctggcctataactgacgctgaggcgcgaaagcgtggggagcaaacagg

SEQ ID NO: 530 - DNA, 253 bp, Unknown
  Kingdom: Bacteria, Phylum: Firmicutes, Class: Bacilli, Order: Bacillales, Family: Paenibacillaceae, Genus:
atacgtagggggcaagcgttgtccggaattattgggcgtaaagcgcgcgcaggcggtcatttaagtctggtgtttaatcccggggctcaaccccggatcgcactggaaactgggtgacttgagtgcagaagaggagagtggaattccacgtgtagcggtgaaatgcgtagagatgtggaggaacaccagtggcgaaggcgactctctgggctgtaactgacgctgaggcgcgaaagcgtggggagcaaacagg

SEQ ID NO: 531 - DNA, 254 bp, Unknown
  Kingdom: Bacteria, Phylum: Firmicutes, Class: Bacilli, Order: Bacillales, Family: Planococcaceae, Genus:
atacgtaggtggcaagcgttgtccggaatcattgggcgtaaagcgcgcgcaggcggtcccttaagtctgatgtgaaagcccacggctcaaccgtggagggtcattggaaactgggggacttgagtgcagaagaggaaagcggaattccaagtgtagcggtgaaatgcgtagagatttggaggaacaccagtggcgaaggcggctttctggtctgtaactgacgctgaggcgcgaaagcgtggggagcaaacagg

SEQ ID NO: 532 - DNA, 254 bp, Unknown
  Kingdom: Bacteria, Phylum: Firmicutes, Class: Bacilli, Order: Bacillales, Family: Planococcaceae, Genus:
atacgtaggtggcaagcgttgtccggaattattgggcgtaaagcgcgcgcaggcggccttttaagtctgatgtgaaagcccccggctcaaccggggagggtcattggaaactggaaggcttgagtgcagaagagaagagcggaattccacgtgtagcggtgaaatgcgtagagatgtggaggaacaccagtggcgaaggcggctctttggtctgtaactgacgctgaggcgcgaaagcgtggggagcgaacagg

SEQ ID NO: 533 - DNA, 254 bp, Unknown
  Kingdom: Bacteria, Phylum: Firmicutes, Class: Bacilli, Order: Bacillales, Family: Planococcaceae, Genus:
atacgtaggtggcaagcgttgtccggaattattgggcgtaaagcgcgcgcaggcggtcctttaagtctgatgtgaaagcccacggctcaaccgtggagggtcattggaaactggaggacttgagtgcagaagagaagagtggaattccacgtgtagcggtgaaatgcgtagagatgtggaggaacaccagtggcgaaggcgactctttggtctgtaactgacgctgaggcgcgaaagcgtggggagcaaacagg

SEQ ID NO: 534 - DNA, 254 bp, Unknown
  Kingdom: Bacteria, Phylum: Firmicutes, Class: Bacilli, Order: Bacillales, Family: Planococcaceae, Genus:
atacgtaggtggcaagcgttgtccggaattattgggcgtaaagcgcgcgcaggcggccttttaagtctgatgtgaaagcccacggctcaaccgtggagggtcattggaaactggaaggcttgagtgcagaagagaagagcggaattccacgtgtagcggtgaaatgcgtagagatgtggaggaacaccagtggcgaaggcggctctttggtctgtaactgacgctgaggcgcgaaagcgtggggagcgaacagg

SEQ ID NO: 535 - DNA, 254 bp, Unknown
  Kingdom: Bacteria, Phylum: Firmicutes, Class: Bacilli, Order: Bacillales, Family: Planococcaceae, Genus:
atacgtaggtggcaagcgttgtccggaattattgggcgtaaagcgcgcgcaggcggtcctttaagtctgatgtgaaagcccacggctcaaccgtggagggtcattggaaactggaggacttgagtgcagaagaggaaagcggaattccacgtgtagcggtgaaatgcgtagagatgtggaggaacaccagtggcgaaggcggctttctggtctgtaactgacgctgaggcgcgaaagcgtggggagcaaacagg

SEQ ID NO: 536 - DNA, 254 bp, Unknown
  Kingdom: Bacteria, Phylum: Firmicutes, Class: Bacilli, Order: Bacillales, Family: Planococcaceae, Genus:
atacgtaggtggcaagcgttgtccggaattattgggcgtaaagcgcgcgcaggcggtcctttaagtctgatgtgaaagcccacggctcaaccgtggagggtcattggaaactggaggacttgagtacagaagaggaaagcggaattccacgtgtagcggtgaaatgcgtagagatgtggaggaacaccagtggcgaaggcggctttctggtctgtaactgacgctgaggcgcgaaagcgtggggagcaaacagg

SEQ ID NO: 537 - DNA, 254 bp, Unknown
  Kingdom: Bacteria, Phylum: Firmicutes, Class: Bacilli, Order: Bacillales, Family: Planococcaceae, Genus:
atacgtaggtggcaagcgttgtccggaattattgggcgtaaagcgcgcgcaggcggtcctttaagtctgatgtgaaagcccacggctcaaccgtggagggtcattggaaactggaggacttgagtgcagaagaggaaagtggaattccacgtgtagcggtgaaatgcgtagagatgtggaggaacaccagtggcgaaggcgactttctggtctgtaactgacgctgaggcgcgaaagcgtggggagcaaacagg

SEQ ID NO: 538 - DNA, 254 bp, Unknown
  Kingdom: Bacteria, Phylum: Firmicutes, Class: Bacilli, Order: Bacillales, Family: Sporolactobacillaceae, Genus:
atacgtaggtggcaagcgttgtccggaattattgggcgtaaagcgcgcgcaggcggtttcttaagtctgatgtgaaagcccccagctcaactggggagggtcattggaaactgggaaacttgagtacagaagaggagagtagaattccacgtgtagcggtgaaatgcgtagagatgtggaggaataccagtggcgaaggcggctctctggtctgtaactgacgctgaggcgcgaaagcgtggggagcaaacagg

SEQ ID NO: 539 - DNA, 254 bp, Unknown
  Kingdom: Bacteria, Phylum: Firmicutes, Class: Bacilli, Order: Bacillales, Family: Staphylococcaceae, Genus:
atacgtaggtggcaagcgttatccggaattattgggcgtaaagcgcgcgtaggcggtttcttaagtctgatgtgaaagcccacggctcaaccgtggagggtcattggaaactgggaaacttgagtgcagaagaggagagtggaattccatgtgtagcggtgaaatgcgcagagatatggaggaacaccagtggcgaaggcggctctctggtctgtaactgacgctgatgtgcgaaagcgtggggatcaaacagg

SEQ ID NO: 540 - DNA, 254 bp, Unknown
  Kingdom: Bacteria, Phylum: Firmicutes, Class: Bacilli, Order: Bacillales, Family: Staphylococcaceae, Genus:
atacgtaggtggcaagcgttatccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacagg

SEQ ID NO: 541 - DNA, 254 bp, Unknown
  Kingdom: Bacteria, Phylum: Firmicutes, Class: Bacilli, Order: Bacillales, Family: Staphylococcaceae, Genus:
atacgtaggtggcaagcgttatccggaattattgggcgtaaagcgcgcgtaggcggtttcttaagtctgatgtgaaagcccacggctcaaccgtggagggtcattggaaactgggagacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacagg

SEQ ID NO: 542 - DNA, 254 bp, Unknown
  Kingdom: Bacteria, Phylum: Firmicutes, Class: Bacilli, Order: Bacillales, Family: Staphylococcaceae, Genus:
atacgtaggtggcaagcgttatccggaattattgggcgtaaagcgcgcgtaggcggtttcttaagtctgatgtgaaagcccacggctcaaccgtggagggtcattggaaactggggaacttgagtgcagaagaggagagtggaattccatgtgtagcggtgaaatgcgcagagatatggaggaacaccagtggcgaaggcggctctctggtctgtaactgacgctgatgtgcgaaagcgtggggatcaaacagg

SEQ ID NO: 543 - DNA, 254 bp, Unknown
  Kingdom: Bacteria, Phylum: Firmicutes, Class: Bacilli, Order: Bacillales, Family: Staphylococcaceae, Genus:
atacgtaggtggcaagcgttatccggaattattgggcgtaaagcgcgcgtaggcggtaaaataagtctgatgtgaaagcccccggctcaaccggggagggtcattggaaactgttttacttgagtacagaagaggagagtggaattccatgtgtagcggtgaaatgcgcagagatatggaggaacaccagtggcgaaggcggctctctggtctgtaactgacgctgaggtgcgaaagcgtggggatcaaacagg

SEQ ID NO: 544 - DNA, 254 bp, Unknown
  Kingdom: Bacteria, Phylum: Firmicutes, Class: Bacilli, Order: Bacillales, Family: Staphylococcaceae, Genus:
atacgtaggtggcaagcgttatccggaattattgggcgtaaagcgcgcgtaggcggttctttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacagg

SEQ ID NO: 545 - DNA, 254 bp, Unknown
  Kingdom: Bacteria, Phylum: Firmicutes, Class: Bacilli, Order: Bacillales, Family: Staphylococcaceae, Genus:
atacgtaggtggcaagcgttatccggaattattgggcgtaaagcgcgcgtaggcggtagaataagtctgatgtgaaagcccctggctcaaccagggagggtcattggaaactgttttacttgagtacagaagaggagagtggaattccatgtgtagcggtgaaatgcgcagagatatggaggaacaccagtggcgaaggcggctctctggtctgtaactgacgctgaggtgcgaaagcgtggggatcaaacagg

SEQ ID NO: 546 - DNA, 255 bp, Unknown
  Kingdom: Bacteria, Phylum: Firmicutes, Class: Bacilli, Order: Bacillales, Family: Staphylococcaceae, Genus:
atacgtaggtggcaagcgttatcccggaattattgggcgtaaagcgcgcgtaggcggttttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacagg

SEQ ID NO: 547 - DNA, 254 bp, Unknown
  Kingdom: Bacteria, Phylum: Firmicutes, Class: Bacilli, Order: Bacillales, Family: Staphylococcaceae, Genus:
atacgtaggtggcaagcgttatccggaattattgggcgtaaagcgcgcgtaggcggtttcttaagtctgatgtgaaagcccacggctcaaccgtggagggtcattggaaactgggaaacttgagtacagaagaggaaagtggaattccatgtgtagcggtgaaatgcgcagagatatggaggaacaccagtggcgaaggcgactttctggtctgtaactgacgctgatgtgcgaaagcgtggggatcaaacagg

SEQ ID NO: 548 - DNA, 254 bp, Unknown
  Kingdom: Bacteria, Phylum: Firmicutes, Class: Bacilli, Order: Bacillales, Family: Staphylococcaceae, Genus:
atacgtaggtggcaagcgttatccggaattattgggcgtaaagcgcgcgtaggcggttttttaagtctgatgtgaaagcccacggctcaaccgtggagggtcattggagactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacagg

SEQ ID NO: 549 - DNA, 254 bp, Unknown
  Kingdom: Bacteria, Phylum: Firmicutes, Class: Bacilli, Order: Bacillales, Family: Staphylococcaceae, Genus:
atacgtaggtggcaagcgttatccggaattattgggcgtaaagcgcgcgtaggcggtttcttaagtctgatgtgaaagcccacggctcaaccgtggagggtcattggaaactgggaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacagg

SEQ ID NO: 550 - DNA, 253 bp, Unknown
  Kingdom: Bacteria, Phylum: Firmicutes, Class: Bacilli, Order: Bacillales, Family: Staphylococcaceae, Genus:
atacgtaggtggcaagcgttatccggaattattgggcgtaaagcgcgcgtaggcggtttttaagtctgatgtgaaagcccacggctcaaccgtggagggtcattggaaactggaaaacttgagtgcagaagaggaaagtggaattccatgtgtagcggtgaaatgcgcagagatatggaggaacaccagtggcgaaggcgactttctggtctgtaactgacgctgatgtgcgaaagcgtggggatcaaacagg

SEQ ID NO: 551 - DNA, 252 bp, Unknown
  Kingdom: Bacteria, Phylum: Firmicutes, Class: Bacilli, Order: Bacillales, Family:  , Genus:
tacgtagggggcaagcgttgtccggaattattgggcgtaaagcgcgcgcaggcggtcgtttaagtcttctgtttaatgcatgggctcaacccgtgtacgcagaggaaactgggcgactggagtgcaggagagggaagtggaattccacgtgtagcggtgaaatgcgtagagatgtggaggaacaccagtggcgaaggcgacttcctggcctgtaactgacgctgaggcgcgaaagcgtggggagcaaacagg

SEQ ID NO: 552 - DNA, 254 bp, Unknown
  Kingdom: Bacteria, Phylum: Firmicutes, Class: Bacilli, Order: Lactobacillales, Family: Aerococcaceae, Genus:
atacgtaggtggcgagcgttgtccggatttattgggcgtaaagggagtgtaggcggtcttttaagtctgatgtgaaagcccacggctcaaccgtggagggtcattggaaactgggagacttgagtgcagaagaggagagcggaattccatgtgtagcggtgaaatgcgtagatatatggaggaacaccagtggcgaaggcggctctctggtctgtaactgacgctgaggctcgaaagcgtggggagcaaacagg

SEQ ID NO: 553 - DNA, 254 bp, Unknown
  Kingdom: Bacteria, Phylum: Firmicutes, Class: Bacilli, Order: Lactobacillales, Family: Enterococcaceae, Genus:
atacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcgaacagg

SEQ ID NO: 554 - DNA, 254 bp, Unknown
  Kingdom: Bacteria, Phylum: Firmicutes, Class: Bacilli, Order: Lactobacillales, Family: Lactobacillaceae, Genus:
atacgtaggtggcaagcgttgtccggatttattgggcgtaaagcgagcgcaggcggattgataagtctgatgtgaaagccttcggctcaaccgaagaactgcatcagaaactgtcaatcttgagtgcagaagaggagagtggaactccatgtgtagcggtggaatgcgtagatatatggaagaacaccagtggcgaaggcggctctctggtctgtaactgacgctgaggctcgaaagcatgggtagcgaacagg

SEQ ID NO: 555 - DNA, 254 bp, Unknown
  Kingdom: Bacteria, Phylum: Firmicutes, Class: Bacilli, Order: Lactobacillales, Family: Leuconostocaceae, Genus:
atacgtatgtcccgagcgttatccggatttattgggcgtaaagcgagcgcagacggttgattaagtctgatgtgaaagcccggagctcaactccggaatggcattggaaactggttaacttgagtgcagtagaggtaagtggaactccatgtgtagcggtggaatgcgtagatatatggaagaacaccagtggcgaaggcggcttactggactgtaactgacgttgaggctcgaaagtgtgggtagcaaacagg

SEQ ID NO: 556 - DNA, 254 bp, Unknown
  Kingdom: Bacteria, Phylum: Firmicutes, Class: Bacilli, Order: Lactobacillales, Family: Leuconostocaceae, Genus:
atacgtatgtcccaagcgttatccggatttattgggcgtaaagcgagcgcaggcggttatttaagtctgatgtgaaagcctacggctcaaccgtagaattgcatcggaaactggatgacttgagtgcagtagaggagagtggaactccatgtgtagcggtgaaatgcgtagatatatggaagaacaccagaggcgaaggcggctctctggactgtaactgacgctgaggctcgaaagtgtgggtagcaaacagg

SEQ ID NO: 557 - DNA, 254 bp, Unknown
  Kingdom: Bacteria, Phylum: Firmicutes, Class: Bacilli, Order: Lactobacillales, Family: Leuconostocaceae, Genus:
atacgtatgttccaagcgttatccggatttattgggcgtaaagcgagcgcagacggttatttaagtctgaagtgaaagccctcagctcaactgaggaattgctttggaaactggatgacttgagtgcagtagaggaaagtggaactccatgtgtagcggtgaaatgcgtagatatatggaagaacaccagtggcgaaggcggctttctggactgtaactgacgttgaggctcgaaagtgtgggtagcaaacagg

SEQ ID NO: 558 - DNA, 254 bp, Unknown
  Kingdom: Bacteria, Phylum: Firmicutes, Class: Bacilli, Order: Lactobacillales, Family: Leuconostocaceae, Genus:
atacgtatgtcccgagcgttatccggatttattgggcgtaaagcgagcgcagacggttgattaagtctgatgtgaaagcccggagctcaactccggaatggcattggaaactggttaacttgagtgttgtagaggtaagtggaactccatgtgtagcggtggaatgcgtagatatatggaagaacaccagtggcgaaggcggcttactggacaacaactgacgttgaggctcgaaagtgtgggtagcaaacagg

SEQ ID NO: 559 - DNA, 253 bp, Unknown
  Kingdom: Bacteria, Phylum: Firmicutes, Class: Bacilli, Order: Lactobacillales, Family: Streptococcaceae, Genus:
atacgtaggtcccgagcgttgtccggatttattgggcgtaaagcgagcgcaggcggttagataagtctgaagttaaaggctgtggcttaaccatagtacgctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacagg

SEQ ID NO: 560 - DNA, 253 bp, Unknown
  Kingdom: Bacteria, Phylum: Firmicutes, Class: Bacilli, Order: Lactobacillales, Family: Streptococcaceae, Genus:
atacgtaggtcccgagcgttgtccggatttattgggcgtaaagcgagcgcaggtggtttattaagtctggtgtaaaaggcagtggctcaaccattgtatgcattggaaactggtagacttgagtgcaggagaggagagtggaattccatgtgtagcggtgaaatgcgtagatatatggaggaacaccggtggcgaaagcggctctctggcctgtaactgacactgaggctcgaaagcgtggggagcaaacagg

SEQ ID NO: 561 - DNA, 253 bp, Unknown
  Kingdom: Bacteria, Phylum: Firmicutes, Class: Bacilli, Order: Lactobacillales, Family: Streptococcaceae, Genus:
atacgtaggtcccgagcgttgtccggatttattgggcgtaaagcgagcgcaggcggtttgataagtctgaagttaaaggctgtggctcaaccatagttcgctttggaaactgtcaaacttgagtgcagaaggggagagtggaattccatgtgtagcggtgaaatgcgtagatatatggaggaacaccggtggcgaaagcggctctctggtctgtaactgacgctgaggctcgaaagcgtggggagcgaacagg

SEQ ID NO: 562 - DNA, 253 bp, Unknown
  Kingdom: Bacteria, Phylum: Firmicutes, Class: Bacilli, Order: Lactobacillales, Family: Streptococcaceae, Genus:
atacgtaggtcccgagcgttatccggatttattgggcgtaaagcgagcgcaggcggttagataagtctgaagttaaaggctgtggcttaaccatagtacgctttggaaactgtttaacttgagtgcagaaggggagagtggaattccatgtgtagcggtgaaatgcgtagatatatggaggaacaccggtggcgaaagcggctctctggtctgtaactgacgctgaggctcgaaagcgtggggagcaaacagg

SEQ ID NO: 563 - DNA, 251 bp, Unknown
  Kingdom: Bacteria, Phylum: Firmicutes, Class: Clostridia, Order: Clostridiales, Family: Clostridiaceae, Genus:
tacgtaggtggcaagcgttgtccggatttactgggcgtaaagggagcgtaggcggacttttaagtgggatgtgaaatacccgggcttaacctgggtgctgcattccaaactgggagtctagagtgcaggaggggaaagtggaattcctagtgtagcggtgaaatgcgtagagattaggaagaacaccagtggcgaaggcgactttctggactgactgacgctgaggctcgaaagcgtggggagcgaacagg

SEQ ID NO: 564 - DNA, 254 bp, Unknown
  Kingdom: Bacteria, Phylum: Firmicutes, Class: Clostridia, Order: Clostridiales, Family: Clostridiaceae_1, Genus:
atacgtaggtggcaagcgttgtccggatttactgggcgtaaagggagcgtaggtggatatttaagtgggatgtgaaatactcgggcttaacctgagtgctgcattccaaactggatatctagagtgcaggagaggaaagtagaattcctagtgtagcggtgaaatgcgtagagattaggaagaataccagtggcgaaggcgactttctggactgtaactgacactgaggctcgaaagcgtggggagcaaacagg

SEQ ID NO: 565 - DNA, 254 bp, Unknown
  Kingdom: Bacteria, Phylum: Firmicutes, Class: Clostridia, Order: Clostridiales, Family: Clostridiaceae_1, Genus:
atacgtaggtggcaagcgttgtccggatttactgggcgtaaagggagcgtaggtggatgtttaagtgggatgtgaaatacctgggcttaacttgggtgctgcattccaaactggatatctagagtgcaggagaggaaagtggaattcctagtgtagcggtgaaatgcgtagagattaggaagaacaccagtggcgaaggcgactttctggactgtaactgacactgaggctcgaaagcgtggggagcaaacagg

SEQ ID NO: 566 - DNA, 254 bp, Unknown
  Kingdom: Bacteria, Phylum: Firmicutes, Class: Clostridia, Order: Clostridiales, Family: Clostridiaceae_1, Genus:
atacgtaggtggcaagcgttgtccggatttactgggcgtaaagggagcgtaggtggatatttaagtgggatgtgaaatactcgggcttaacttgagtgctgcattccaaactggatatctagagtgcaggagaggaaagtagaattcctagtgtagcggtgaaatgcgtagagattaggaagaataccagtggcgaaggcgactttctggactgtaactgacactgaggctcgaaagcgtggggagcaaacagg

SEQ ID NO: 567 - DNA, 254 bp, Unknown
  Kingdom: Bacteria, Phylum: Firmicutes, Class: Clostridia, Order: Clostridiales, Family: Clostridiaceae_1, Genus:
atacgtaggtggcaagcgttgtccggatttactgggcgtaaagggagcgtaggtggatatttaagtgggatgtgaaatactcgggcttaacctgggtgctgcattccaaactgaatatctagagtgcaggagaggaaagtagaattcctagtgtagcggtgaaatgcgtagagattaggaagaataccagtggcgaaggcgactttctggactgtaactgacactgaggctcgaaagcgtggggagcaaacagg

SEQ ID NO: 568 - DNA, 254 bp, Unknown
  Kingdom: Bacteria, Phylum: Firmicutes, Class: Clostridia, Order: Clostridiales, Family: Clostridiaceae_1, Genus:
atacgtaggtggcaagcgttgtccggatttactgggcgtaaagggagcgtaggtggatatttaagtgggatgtgaaatactcgggcttaacctgggtgctgcattccaaactggatatctagagtgcaggagaggaaagtagaattcctagtgtagcggtgaaatgcgtagagattaggaagaataccagtggcgaaggcgactttctggactgtaactgacactgaggctcgaaagcgtggggagcaaacagg

SEQ ID NO: 569 - DNA, 254 bp, Unknown
  Kingdom: Bacteria, Phylum: Firmicutes, Class: Clostridia, Order: Clostridiales, Family: Clostridiaceae_1, Genus:
atacgtaggtggcaagcgttgtccggatttactgggcgtaaagggagcgtaggcggatacttaagtgggatgtgaaatacctgggcttaacttgggtgctgcattccaaactgggtgtctagagtgttggagaggaaagtggaattcctagtgtagcggtgaaatgcgtagagattaggaagaacaccagtggcgaaggcgactttctggacaataactgacgctgaggctcgaaagcgtggggagcaaacagg

SEQ ID NO: 570 - DNA, 254 bp, Unknown
  Kingdom: Bacteria, Phylum: Firmicutes, Class: Clostridia, Order: Clostridiales, Family: Family_XI, Genus:
atacgtatggagcgagcgttgtccggaattattgggcgtaaagggtgcgcaggcggctttacaagttggatgtgaaatattgtggctcaaccacaaacgtgcatccaaaactgcaaagcttgagttaaggagaggtaagtggaattcctggtgtagcggtggaatgcgtagatatcaggaggaataccggtggcgaaggcgacttactggacttaaactgacgctcaggcacgaaagcgtggggagcaaacagg

SEQ ID NO: 571 - DNA, 254 bp, Unknown
  Kingdom: Bacteria, Phylum: Firmicutes, Class: Clostridia, Order: Clostridiales, Family: Lachnospiraceae, Genus:
atacgtagggggcaagcgttatccggatttactgggtgtaaagggagcgtagacggctctgcaagtctggagtgaaagcccggggctcaaccccgggactgctttggaaactgtggagctagagtgcaggagaggtaagtggaattcctagtgtagcggtgaaatgcgtagatattaggaggaacaccagtggcgaaggcggcttactggactgtaactgacgttgaggctcgaaagcgtggggagcaaacagg

SEQ ID NO: 572 - DNA, 253 bp, Unknown
  Kingdom: Bacteria, Phylum: Firmicutes, Class: Clostridia, Order: Clostridiales, Family: Peptostreptococcaceae, Genus:
atacgtagggggctagcgttatccggaattactgggcgtaaagggtgcgtaggtggttttttaagtcagaagtgaaaggctacggctcaaccgtagtaagcttttgaaactgagaaacttgagtgcaggagaggagagtagaattcctagtgtagcggtgaaatgcgtagatattaggaggaataccagttgcgaaggcggctctctggactgtaactgacactgaggcacgaaagcgtggggagcaaacagg

SEQ ID NO: 573 - DNA, 253 bp, Unknown
  Kingdom: Bacteria, Phylum: Firmicutes, Class: Clostridia, Order: Clostridiales, Family: Peptostreptococcaceae, Genus:
atacgtagggggctagcgttatccggaattactgggcgtaaagggtgcgtaggtggtttcttaagtcagaggtgaaaggctacggctcaaccgtagtaagcctttgaaactgggaaacttgagtgcaggagaggagagtggaattcctagtgtagcggtgaaatgcgtagatattaggaggaacaccagttgcgaaggcggctctctggactgtaactgacactgaggcgcgaaagcgtggggagcaaacagg

SEQ ID NO: 574 - DNA, 253 bp, Unknown
  Kingdom: Bacteria, Phylum: Firmicutes, Class: Clostridia, Order: Clostridiales, Family: Peptostreptococcaceae, Genus:
atacgtagggggctagcgttatccggaattactgggcgtaaagggtgcgtaggtggtttcttaagtcagaagtgaaaggctacggctcaaccgtagtaagcttttgaaactgagaaacttgagtgcaggagaggagagtagaattcctagtgtagcggtgaaatgcgtagatattaggaggaataccagttgcgaaggcggctctctggactgtaactgacactgaggcacgaaagcgtggggagcaaacagg

SEQ ID NO: 575 - DNA, 253 bp, Unknown
  Kingdom: Bacteria, Phylum: Firmicutes, Class: Clostridia, Order: Clostridiales, Family: Peptostreptococcaceae, Genus:
atacgtagggggctagcgttatccggaattactgggcgtaaagggtgcgtaggtggtttcttaagtcagaggtgaaaggctacggctcaaccgtagtaagcctttgaaactgggaaacttgagtgcaggagaggagagtggaattcctagtgtagcggtgaaatgcgtagatattaggaggaacaccagttgcgaaggcggctctctggactgtaactgacactgaggcacgaaagcgtggggagcaaacagg

SEQ ID NO: 576 - DNA, 251 bp, Unknown
  Kingdom: Bacteria, Phylum: Firmicutes, Class: Clostridia, Order: Thermoanaerobacterales, Family: Carboxydocellaceae, Genus:
aacgtagggggcgagcgttatccggaattactgggcgtaaagcgcgtgtaggcgggctgttaagtcggttgtgaaaatccggggctcaacttcggacatgcagccgatactgacagtcttgagggcaggagagggaagcggaattcccggtgtagcggtgaaatgcgtagatatcgggaggaacaccagtggcgaaggcggctttctggactgcctgacgctgagacgcgaaagcgtggggagcaaacagg

SEQ ID NO: 577 - DNA, 254 bp, Unknown
  Kingdom: Bacteria, Phylum: Firmicutes, Class: Clostridia, Order: Thermoanaerobacterales, Family: Family_III, Genus:
atacgtaggtggcgagcgttgtccggaattactgggcgtaaagggtgcgtaggcggcctggtaagttgagcgtgaaatttttgggctcaacccaaaaggagcgctcaagactgccgggcttgagtgcgggagaggacggcggaattcccggtgtagcggtgaaatgcgtagatatcgggaggaacaccagtggcgaaggcggccgtctggaccgtaactgacgctgaggcacgaaagcgtggggagcaaacagg

SEQ ID NO: 578 - DNA, 254 bp, Unknown
  Kingdom: Bacteria, Phylum: Firmicutes, Class: Clostridia, Order: Thermoanaerobacterales, Family: Family_III, Genus:
atacgtagggggcgagcgttgtccggaattactgggcgtaaagagcacgtaggcggctataaaagtcagatgtaaaaaacctgggcttaaccgaggggatgcaactgaaactatatagcttgagtcaaggagaggagagcggaattcctggtgtagcggtgaaatgcgtagagatcaggaagaataccagtggcgaaagcggctctctggacttgaactgacgctgaggtgcgaaagcgtggggagcaaacagg

SEQ ID NO: 579 - DNA, 254 bp, Unknown
  Kingdom: Bacteria, Phylum: Firmicutes, Class: Clostridia, Order: Thermoanaerobacterales, Family: Family_III, Genus:
atacgtagggggcgagcgttgtccggaattactgggcgtaaagagcacgtaggcggctataaaagtcagatgtgaaaaacctgggctcaaccgagggtatgcatctgaaactaaatagcttgagtcaaggagaggagagcggaattcctggtgtagcggtgaaatgcgtagagatcaggaagaataccagtggcgaaagcggctctctggacttgaactgacgctgaggtgcgaaagcgtggggagcaaacagg

SEQ ID NO: 580 - DNA, 254 bp, Unknown
  Kingdom: Bacteria, Phylum: Firmicutes, Class: Clostridia, Order: Thermoanaerobacterales, Family: Family_III, Genus:
atacgtagggggcgagcgttgtccggaattactgggcgtaaagagcacgtaggcggctatataagtcaggtgtgaaaaacctgggcttaaccgagggtatgcatctgaaactatatagcttgagtcaaggagaggagagcggaattcctggtgtagcggtgaaatgcgtagagatcaggaagaataccagtggcgaaagcggctctctggacttgaactgacgctgaggtgcgaaagcgtggggagcaaacagg

SEQ ID NO: 581 - DNA, 253 bp, Unknown
  Kingdom: Bacteria, Phylum: Firmicutes, Class: Negativicutes, Order: Selenomonadales, Family: Veillonellaceae, Genus:
atacgtaggtggcaagcgttgtccggaattattgggcgtaaagcgcgcgcaggcggattggtcagtctgtcttaaaagttcggggcttaaccccgtgatgggatggaaactgccaatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacggg

SEQ ID NO: 582 - DNA, 253 bp, Unknown
  Kingdom: Bacteria, Phylum: Firmicutes, Class: Negativicutes, Order: Selenomonadales, Family: Veillonellaceae, Genus:
atacgtaggtggcaagcgttgtccggaattattgggcgtaaagggcgcgcaggcggttcggtaagtctgtcttaaaagtgcggggcttaaccccgtgaggggacggaaactgtcgaacttgagtgtcggagaggaaagcggaattcctagtgtagcggtgaaatgcgtagatattaggaggaacaccggtggcgaaagcggctttctggacgacaactgacgctgaggcgcgaaagcgtggggagcaaacagg

SEQ ID NO: 583 - DNA, 253 bp, Unknown
  Kingdom: Bacteria, Phylum: Firmicutes, Class: Negativicutes, Order: Selenomonadales, Family: Veillonellaceae, Genus:
atacgtaggtggcaagcgttgtccggaattattgggcgtaaagcgcgcgcaggcggatcagtcagtctgtcttaaaagttcggggcttaaccccgtgatgggatggaaactgctgatctagagtatcggagaggaaagtggaattcctagtgtagcggtgaaatgcgtagatattaggaagaacaccagtggcgaaggcgactttctggacgaaaactgacgctgaggcgcgaaagccaggggagcgaacggg

SEQ ID NO: 584 - DNA, 253 bp, Unknown
  Kingdom: Bacteria, Phylum: Fusobacteria, Class: Fusobacteriia, Order: Fusobacteriales, Family: Fusobacteriaceae, Genus:
atacgtatgtcacaagcgttatccggatttattgggcgtaaagcgcgtctaggtggttatgtaagtctgatgtgaaaatgcagggctcaactctgtattgcgttggaaactgcatgactagagtactggagaggtaagcggaactacaagtgtagaggtgaaattcgtagatatttgtaggaatgccgatggggaagccagcttactggacagatactgacgctaaagcgcgaaagcgtgggtagcaaacagg

SEQ ID NO: 585 - DNA, 251 bp, Unknown
  Kingdom: Bacteria, Phylum: Gemmatimonadetes, Class: Gemmatimonadetes, Order: Ellin5290, Family:  , Genus:
tacagagggtgcgagcgttgtccggaatcactgggcgtaaagggcgcgtaggtggcgatccaagtccatggtgaaagctcgatgctcaacatcgagtcggccacggatactgggttgcttgagcactgtaggggcagatggaattccgggtgtagcggtggaatgcgtagagatccggaagaacaccggtggcgaaggcggtctgctgggcaggctgacactgaggcgcgacagcgtggggagcaaacagg

SEQ ID NO: 586 - DNA, 251 bp, Unknown
  Kingdom: Bacteria, Phylum: Gemmatimonadetes, Class: Gemmatimonadetes, Order: Gemmatimonadales, Family: Gemmatimonadaceae, Genus: Gemmatimonas
tacggagggtgcgagcgttgtccggaatcactgggcgtaaagggcgcgtaggcggtctgctaagcgtgcggtgaaagcctggggctcaaccccaggtctgccgtgcgaactggtggactagagcactgtagaggcaggtggaattccgggtgtagcggtggaatgcgtagagatccggaagaacaccggtggcgaaggcggcctgctgggcaggctgacgctgaggcgcgacagcgtggggagcaaacagg

SEQ ID NO: 587 - DNA, 257 bp, Unknown
  Kingdom: Bacteria, Phylum: Gemmatimonadetes, Class: Gemmatimonadetes, Order: Gemmatimonadales, Family: Gemmatimonadaceae, Genus:
atacggagggtgcgagcgttgtccggaatcattgggcgtaaagggcgcgtaggtggcccggtcagtccgtggtgaaagcgcggggctcaaccctgcgtcggccatggatactgccgcggctcgagcactgtagaggcaggcggaattccgggtgtagcggtggaatgcgtagagatccggaagaacaccggtggcgaaggcggcctgctgggcagtttagctgacactgaggcgcgacagcgtggggagcaaacagg

SEQ ID NO: 588 - DNA, 255 bp, Unknown
  Kingdom: Bacteria, Phylum: Gemmatimonadetes, Class: Gemmatimonadetes, Order: Gemmatimonadales, Family: Gemmatimonadaceae, Genus:
atacggagggtgcgagcgttgtccggaatcactgggcgtaaagggcgcgtaggtggcctgtggaagtctgcggtgaaagcccggcgctcaacgccgggtcggccgtggatactctcgggcttgagcttactggaggcagatggaattccgggtgtagcggtggaatgcgtagagatccggaagaacaccggtggcgaaggcggtctgctggggtaatgctgacactgatgcgcgacagcgtggggagcaaacagg

SEQ ID NO: 589 - DNA, 254 bp, Unknown
  Kingdom: Bacteria, Phylum: Gemmatimonadetes, Class: Gemmatimonadetes, Order: Gemmatimonadales, Family: Gemmatimonadaceae, Genus:
atacagagggtgcgagcgttgtccggaatcactgggcgtaaagggcgcgtaggcggctcggtaaggttgcggtgaaagcccggggctcaaccccgggtcggccgtggcaactgctgggctggagcactgtagaggcaggtggaattccgggtgtagcggtggaatgcgtagagatccggaagaacaccggtggcgaaggcggcctgctgggcagtagctgacgctgatgcgcgacagcgtggggagcaaacagg

SEQ ID NO: 590 - DNA, 254 bp, Unknown
  Kingdom: Bacteria, Phylum: Gemmatimonadetes, Class: Gemmatimonadetes, Order: Gemmatimonadales, Family: Gemmatimonadaceae, Genus:
atacagagggtgcgagcgttgtccggaattactgggcgtaaagggcgcgtaggcggcttgataagtaggaggtgaaattccatggctcaaccatggatcggccttctagactgtcaggcttgagcacggtagaggcagatggaattcccggtgtagcggtggaatgcgtagagatcgggaagaacaccagtggcgaaggcggtctgctgggccgttgctgacgctgaggcgcgacagcgtggggagcaaacagg

SEQ ID NO: 591 - DNA, 254 bp, Unknown
  Kingdom: Bacteria, Phylum: Gemmatimonadetes, Class: Gemmatimonadetes, Order: Gemmatimonadales, Family: Gemmatimonadaceae, Genus:
atacggagggtgcgagcgttgtccggaatcactgggcgtaaagggcgcgtaggcggcctgataagtagggggtgaaatcttgcggcttaaccgcaaggctgccttctaaactgtcgggctcgagcacagtagaggcaggtggaattcccggtgtagcggtggaatgcgtagagatcgggaagaacatcagtggcgaaggcggcctgctgggctgttgctgacgctgaggcgcgacagcgtggggagcaaacagg

SEQ ID NO: 592 - DNA, 254 bp, Unknown
  Kingdom: Bacteria, Phylum: Gemmatimonadetes, Class: Gemmatimonadetes, Order: Gemmatimonadales, Family: Gemmatimonadaceae, Genus:
atacggggggtgcgagcgttgtccggaatcactgggcgtaaagggcgcgtaggtggtttgataagggtgtggtgaaagcccggagctcaactccgggtctgccgtgccgactgtcaaactcgaggactgtagaggcagacggaattccgggtgtagcggtggaatgcgtagagatccggaggaagaccggtggcgaaggcggtctgctgggcagtttctgacactgaggcgcgacagcgtggggagcaaacagg

SEQ ID NO: 593 - DNA, 255 bp, Unknown
  Kingdom: Bacteria, Phylum: Gemmatimonadetes, Class: Gemmatimonadetes, Order: Gemmatimonadales, Family: Gemmatimonadaceae, Genus:
atacagagggtgcgagcgttgtccggaatcactgggcgtaaagggcgcgtaggtggtggcttaagcgtgcggtgaaagctcggagctcaactccgagtcggccgtgcgaactgggctcactggagcatagtagaggcaggtggaattccgggtgtagcggtggaatgcgtagagatccggaagaacaccggtggcgaaggcggcctgctgggctatggctgacactgaggcgcgacagcgtggggagcaaacagg

SEQ ID NO: 594 - DNA, 254 bp, Unknown
  Kingdom: Bacteria, Phylum: Gemmatimonadetes, Class: Gemmatimonadetes, Order: Gemmatimonadales, Family: Gemmatimonadaceae, Genus:
atacggagggtgcgagcgttgtccggaatcactgggcgtaaagggcgcgtaggcggcctgataagtagggggtgaaatcctgcggcttaaccgcagggctgccttctaaactgtcaggctcgagcacagtagaggcaggtggaattcccggtgtagcggtggaatgcgtagagatcgggaagaacatcagtggcgaaggcggcctgctgggctgttgctgacgctgaggcgcgacagcgtggggagcaaacagg

SEQ ID NO: 595 - DNA, 254 bp, Unknown
  Kingdom: Bacteria, Phylum: Gemmatimonadetes, Class: Gemmatimonadetes, Order: Gemmatimonadales, Family: Gemmatimonadaceae, Genus:
atacggggggtgcgagcgttgtccggaatcactgggcgtaaagggcgcgtaggtggtttgataagggtgtggtgaaagtccggggctcaaccccggatctgccgtgccgactgtcaaactcgagggctgtagaggcagacggaattccgggtgtagcggtggaatgcgtagagatccggaggaagaccggtggcgaaggcggtctgctgggcagtttctgacactgatgcgcgacagcgtggggagcaaacagg

SEQ ID NO: 596 - DNA, 254 bp, Unknown
  Kingdom: Bacteria, Phylum: Gemmatimonadetes, Class: Gemmatimonadetes, Order: Gemmatimonadales, Family: Gemmatimonadaceae, Genus:
atacagagggtgcgagcgttgtccggaatcactgggcgtaaagggcgcgtaggcggttttgtaagtcgggggtgaaatgctgcggctcaaccgcagcgctgcctccgagactgcaagactggagcacggtagaggcggatggaattcccggtgtagcggtggaatgcgtagagatcgggaagaacaccaatggcgaaggcagtccgctgggccgttgctgacgctgaggcgcgacagcgtggggagcaaacagg

SEQ ID NO: 597 - DNA, 255 bp, Unknown
  Kingdom: Bacteria, Phylum: Gemmatimonadetes, Class: Gemmatimonadetes, Order: Gemmatimonadales, Family: Gemmatimonadaceae, Genus:
atacggagggtgcgagcgttgtccggaatcattgggcgtaaagggcgcgtaggtggcccggtcagttcgtggtgaaagcgcggggctcaaccctgcgtcggccatgaatactgccgcggctggagcactgtagaggcaggcggaattccgggtgtagcggtggaatgcgtagagatccggaagaacaccggtggcgaaggcggcctgctgggcagttgctgacactgaggcgcgacagcgtggggagcaaacagg

SEQ ID NO: 598 - DNA, 251 bp, Unknown
  Kingdom: Bacteria, Phylum: Gemmatimonadetes, Class: Gemmatimonadetes, Order:  , Family:  , Genus:
tacagagggtgcgagcgttgtccggaatcactgggcgtaaagggcgcgtaggcggctcggtaagcgtgcggtgaaagcccggggctcaaccccgggtcggccgtgcgaactgcggagctggagcactgtagaggcaggtggaattccgggtgtagcggtggaatgcgtagagatccggaagaacaccggtggcgaaggcggcctgctgggcaggctgacgctgaggcgcgacagcgtggggagcaaacagg

SEQ ID NO: 599 - DNA, 254 bp, Unknown
  Kingdom: Bacteria, Phylum: Planctomycetes, Class: OM190, Order: , Family:  , Genus:
atacagagagtgcaaacgttgttcggaattactgggcttaaagcgcacgtaggctgcgtcgtaagtgtcaggtgaaatcccacggctcacccgtggaactgcctggcatactgcgatgctcgagtgtggtaggggagagcggaactcctggtggagcggtgaaatgcgtagatatcaggaggaacaccggtggcgaaggcggctctctggtccacaactgacgctgaggtgcgaaagctaggggagcaaacggg

SEQ ID NO: 600 - DNA, 251 bp, Unknown
  Kingdom: Bacteria, Phylum: Planctomycetes, Class: Phycisphaerae, Order: WD2101, Family:  , Genus:
tacagaggccccaagcgttaggcggaatcactgggcttaaagcgtgtgtaggcgggttggtaagtactttgtgaaatcccacggcttaaccgtggaattgcttggtatactgccgatcttgagtcatttaggggcagccggaacagatggtggagcggtgaaatgcgtagatatcatctggaacgccaatggtgcagacaggctgctgggaatactgacgctgaggcacgaaagccaggggagcgaacggg

SEQ ID NO: 601 - DNA, 254 bp, Unknown
  Kingdom: Bacteria, Phylum: Planctomycetes, Class: Phycisphaerae, Order: WD2101_soil_group, Family:  , Genus:
agacagaggcctcaagcgttaggcggaatcactgggcttaaagcgtgtgtaggcggatcgttaagtgtcttgtgaaatcccacggctcacccgtggaactgctgggcatactggcgatcttgggccaactaggggcaactggaacaagcggtggagcggtgaaatgcgtagatatcgcttggaacgccaaaggtgaaaacaggttgctggggttgtgccgacgctgagacacgaaagccaggggagcaaacggg

SEQ ID NO: 602 - DNA, 255 bp, Unknown
  Kingdom: Bacteria, Phylum: Planctomycetes, Class: Planctomycetacia, Order: Planctomycetales, Family: Planctomycetaceae, Genus: Candidatus_Nostocoida
agacgaaccgtgcgaacgttattcggaatcactgggcttaaagcgcgtgtaggcgggacggcacgtcggccgctgaaatcccccggctcaaccggggaacgggcgccgatacgaccgtcctggagggacgtagggggacctggaacttccggtggagcggtgaaatgcgttgagatcggaaggaacgcccgtggcgaaagcgaggtcctggacgttttctgacgctgagacgcgaaagccaggggagcgaacggg

SEQ ID NO: 603 - DNA, 254 bp, Unknown
  Kingdom: Bacteria, Phylum: Planctomycetes, Class: Planctomycetacia, Order: Planctomycetales, Family: Planctomycetaceae, Genus: Gemmata
agacgaaccgagcgaacgttgttcggaatcactgggcttaaagggcgcgtaggcgggctgtcaagtctggggtgaaatcccgcggctcaaccgtggaactgcctcagatactgacggcctcgagggagataggggcgagcggaactaatggtggagcggtgaaatgcgttgatatcattaggaactccggtggcgaaggcggctcgctggatcttttctgacgctgaggcgcgaaagctaggggagcaaacggg

SEQ ID NO: 604 - DNA, 254 bp, Unknown
  Kingdom: Bacteria, Phylum: Planctomycetes, Class: Planctomycetacia, Order: Planctomycetales, Family: Planctomycetaceae, Genus: Pirellula
atacgagaggcccaaacgttattcggatttactgggcttaaagagttcgtaggcggttcggtaagtgaggtgtgaaagccctcggctcaaccgaggaattgcgcttcaaactgccgggctcgagggagatagaggtgagcggaactgatggtggagcggtgaaatgcgttgatatcatcaggaacaccagaggcgaaggcggctcactgggtctcttctgacgctgaggaacgaaagctaggggagcaaacggg

SEQ ID NO: 605 - DNA, 254 bp, Unknown
  Kingdom: Bacteria, Phylum: Planctomycetes, Class: Planctomycetacia, Order: Planctomycetales, Family: Planctomycetaceae, Genus:
atacgaactgtgcaaacgttattcggaatcactgggcttacagggtgcgtaggtggccggacaagtcaggtgtgaaatccctcagctcaactgaggaactgcgcttgaaactgtttggctagagtgagctaggggtacttggaactgccagtggagcggtgaaatgtgttgatattggcaggaacaccggagccgaaagggaagtactggggcttaactgacactgaggcacgaaagccaggggagcaaacggg

SEQ ID NO: 606 - DNA, 254 bp, Unknown
  Kingdom: Bacteria, Phylum: Planctomycetes, Class: Planctomycetacia, Order: Planctomycetales, Family: Planctomycetaceae, Genus:
acacgaaccgtacgaacgttattcggaattactgggcttaaagggtttgtaggcggccttgtaagtcaggtgtgaaagccctcggctcaaccgaggaacagcgcttgatactgcaaggcttgagggagacaggggtaagcggaactgatggtggagcggtgaaatgcgttgatatcatcaggaacaccggtggcgaaagcggcttactgggtctcttctgacgctgaggaacgaaagctagggtagcgaacggg

SEQ ID NO: 607 - DNA, 254 bp, Unknown
  Kingdom: Bacteria, Phylum: Planctomycetes, Class: Planctomycetacia, Order: Planctomycetales, Family: Planctomycetaceae, Genus:
agacgaaccgtacaaacgttattcggaatcactgggcttaaagggtgcgtaggcggcgctgtaagttgggtgtgaaatccctcggctcaaccgaggaactgcgcccaaaactacagtgcttgagggagatagaggtgagcggaacttagggtggagcggtgaaatgcgttgatatcctaaggaacgccaggggcgaaagcggctcactgggtctcttctgacgctgaggcacgaaagctagggtagcgaacggg

SEQ ID NO: 608 - DNA, 251 bp, Unknown
  Kingdom: Bacteria, Phylum: Planctomycetes, Class: Planctomycetia, Order: Planctomycetales, Family: Planctomycetaceae, Genus: Planctomyces
gacgaactgtgcaaacgttattcggaatcactgggcttgaagagtgcgtaggcggttttgtaagtagggtgtgaaagcccccggctcaaccggggaattgcgccctagactgcaaggctggagtgaggtaggggtgtgtggaacttccagtggagcggtgaaatgtgttgatattggaaggaacgccggtggcgaaagcgacacactggaccttctgacgctgaggcacgaaagccaggggagcaaacggg

SEQ ID NO: 609 - DNA, 254 bp, Unknown
  Kingdom: Bacteria, Phylum: Planctomycetes, Class: vadinHA49, Order:  , Family:  , Genus:
atacatgtggggcaagcgttgttcggaattactgggcataaagggtgcgtaggtggtttgttaagtcaggggtgaaatcccgcggcccaaccgtggaactgcctttgatactggcgaacttgagtgcgtgaggggtagggggaacgagcagtgtagcggtgaaatgcgtagatattgctcggaaggccagagccgaaggggccctactggtgcgcaactgacactgaggcacgaaagcgtggggagcaaacagg

SEQ ID NO: 610 - DNA, 251 bp, Unknown
  Kingdom: Bacteria, Phylum: Proteobacteria, Class: Alphaproteobacteria, Order: BD7-3, Family:  , Genus:
tacgaatggggcaagcgttgttcggaatcactgggcttaaagcgtgcgtaggcggatttgcaagtcagaagtgaaatccccgggcttaacccgggaattgcttttgaaactgcaaatctagaatcttgaagaggttagcagaattccgagtgtggaggtgaaattcgcagatattcggaggaataccaatggcgtaggcagctaactgggcaaattgacgctgaggcacgaaagcgtggggagcaaacagg

SEQ ID NO: 611 - DNA, 254 bp, Unknown
  Kingdom: Bacteria, Phylum: Proteobacteria, Class: Alphaproteobacteria, Order: Caulobacterales, Family: Caulobacteraceae, Genus:
atacgaagggggctagcgttgctcggaattactgggcgtaaagggagcgtaggcggactgttaagttagaggtgaaagcccagggctcaaccttggaattgcctttgatactggcagtcttgagtacggaagaggtatgtggaactccgagtgtagaggtgaaattcgtagatattcggaagaacaccagtggcgaaggcgacatactggtccgttactgacgctgaggctcgaaagcgtggggagcaaacagg

SEQ ID NO: 612 - DNA, 254 bp, Unknown
  Kingdom: Bacteria, Phylum: Proteobacteria, Class: Alphaproteobacteria, Order: Caulobacterales, Family: Caulobacteraceae, Genus:
atacgaagggggctagcgttgctcggaattactgggcgtaaagggcgcgtaggcggacatttaagtcaggggtgaaatcccagagctcaactctggaactgcctttgatactgggtgtcttgagtgtgagagaggtatgtggaactccgagtgtagaggtgaaattcgtagatattcggaagaacaccagtggcgaaggcgacatactggctcattactgacgctgaggcgcgaaagcgtggggagcaaacagg

SEQ ID NO: 613 - DNA, 251 bp, Unknown
  Kingdom: Bacteria, Phylum: Proteobacteria, Class: Alphaproteobacteria, Order: Caulobacterales, Family: Caulobacteraceae, Genus:
tacgaagggggctagcgttgctcggaattactgggcgtaaagggcgcgtaggcggacagtttagtcagaggtgaaagcccagggctcaaccttggaattgcctttgatactggctgtcttgagttcgggagaggtgagtggaatgccgagtgtagaggtgaaattcgtagatattcggcggaacaccagtggcgaaggcgactcactggcccgactgacgctgaggcgcgaaagcgtggggagcaaacagg

SEQ ID NO: 614 - DNA, 254 bp, Unknown
  Kingdom: Bacteria, Phylum: Proteobacteria, Class: Alphaproteobacteria, Order: Caulobacterales, Family: Caulobacteraceae, Genus:
atacgaagggggctagcgttgctcggaattactgggcgtaaagggcgcgtaggcggatatctaagttgggggtgaaagcccggggctcaacctcggaatagccttcaatactggatatcttgagttcgggagaggtgagtggaatgccgagtgtagaggtgaaattcgtagatattcggcggaacaccagtggcgaaggcgactcactggcccgatactgacgctgaggcgcgaaagcgtggggagcaaacagg

SEQ ID NO: 615 - DNA, 251 bp, Unknown
  Kingdom: Bacteria, Phylum: Proteobacteria, Class: Alphaproteobacteria, Order: Caulobacterales, Family: Caulobacteraceae, Genus:
tacgaagggggctagcgttgctcggaattactgggcgtaaagggagcgtaggcgggttatcaagttggaggtgaaagcccagggctcaaccttggaattgccttcaaaactgatagcctagagtatgatagaggtaagtggaactccgagtgtagaggtgaaattcgtagatattcggaagaacaccagtggcgaaggcgacttactggatcaactgacgctgaggctcgaaagcgtggggagcaaacagg

SEQ ID NO: 616 - DNA, 254 bp, Unknown
  Kingdom: Bacteria, Phylum: Proteobacteria, Class: Alphaproteobacteria, Order: Caulobacterales, Family: Caulobacteraceae, Genus:
atacgaagggggctagcgttgctcggaattactgggcgtaaagggagcgtaggcggatagtttagtcagaggtgaaagcccagggctcaaccttggaattgcctttgatactggctatcttgagtacggaagaggtatgtggaactccgagtgtagaggtgaaattcgtagatattcggaagaacaccagtggcgaaggcgacatactggtccgttactgacgctgaggctcgaaagcgtggggagcaaacagg

SEQ ID NO: 617 - DNA, 254 bp, Unknown
  Kingdom: Bacteria, Phylum: Proteobacteria, Class: Alphaproteobacteria, Order: Caulobacterales, Family: Caulobacteraceae, Genus:
atacgaagggggctagcgttgctcggaattactgggcgtaaagggagcgtaggcggacatttaagtcaggggtgaaatcccggggctcaacctcggaattgcctttgatactgggtgtcttgagtatgagagaggtatgtggaactccgagtgtagaggtgaaattcgtagatattcggaagaacaccagtggcgaaggcgacatactggctcattactgacgctgaggctcgaaagcgtggggagcaaacagg

SEQ ID NO: 618 - DNA, 254 bp, Unknown
  Kingdom: Bacteria, Phylum: Proteobacteria, Class: Alphaproteobacteria, Order: Caulobacterales, Family: Caulobacteraceae, Genus:
atacgaagggggctagcgttgctcggaattactgggcgtaaagggagcgtaggcgggtcgtcaagttgggggtgaaagcccagggctcaaccttggaattgccttcaaaactgacgatctagagtatggaagaggtaagtggaactccgagtgtagaggtgaaattcgtagatattcggaagaacaccagtggcgaaggcgacttactggtccatgactgacgctgaggctcgaaagcgtggggagcaaacagg

SEQ ID NO: 619 - DNA, 254 bp, Unknown
  Kingdom: Bacteria, Phylum: Proteobacteria, Class: Alphaproteobacteria, Order: Caulobacterales, Family: Caulobacteraceae, Genus:
atacgaagggggctagcgttgctcggaattactgggcgtaaagggcgcgtaggcggacagtttagtcagaggtgaaagcccagggctcaaccttggaattgcctttgatactggctgtcttgagttcgggagaggtgagtggaatgccgagtgtagaggtgaaattcgtagatattcggcggaacaccagtggcgaaggcgactcactggcccgatactgacgctgaggcgcgaaagcgtggggagcaaacagg

SEQ ID NO: 620 - DNA, 254 bp, Unknown
  Kingdom: Bacteria, Phylum: Proteobacteria, Class: Alphaproteobacteria, Order: Caulobacterales, Family: Caulobacteraceae, Genus:
atacgaagggggctagcgttgctcggaattactgggcgtaaagggcgcgtaggcggacagttaagtcgggggtgaaagcccggggctcaacctcggaattgccttcgatactggctgtcttgagtacgggagaggtgtgtggaactccgagtgtagaggtgaaattcgtagatattcggaagaacaccagtggcgaaggcgacacactggcccgttactgacgctgaggcgcgaaagcgtggggagcaaacagg

SEQ ID NO: 621 - DNA, 254 bp, Unknown
  Kingdom: Bacteria, Phylum: Proteobacteria, Class: Alphaproteobacteria, Order: Caulobacterales, Family: Caulobacteraceae, Genus:
atacgaagggggctagcgttgctcggaattactgggcgtaaagggagcgtaggcggactgtttagtcagaggtgaaagcccagggctcaaccttggaattgcctttgatactggcagtcttgagtacggaagaggtatgtggaactccgagtgtagaggtgaaattcgtagatattcggaagaacaccagtggcgaaggcgacatactggtccgttactgacgctgaggctcgaaagcgtggggagcaaacagg

SEQ ID NO: 622 - DNA, 254 bp, Unknown
  Kingdom: Bacteria, Phylum: Proteobacteria, Class: Alphaproteobacteria, Order: Caulobacterales, Family: Caulobacteraceae, Genus:
atacgaagggggctagcgttgctcggaattactgggcgtaaagggagcgtaggcggacatttaagtcaggggtgaaatcccagagctcaactctggaactgcctttgatactgggtgtcttgagtgtgatagaggtatgtggaactccgagtgtagaggtgaaattcgtagatattcggaagaacaccagtggcgaaggcgacatactggatcattactgacgctgaggctcgaaagcgtggggagcaaacagg

SEQ ID NO: 623 - DNA, 254 bp, Unknown
  Kingdom: Bacteria, Phylum: Proteobacteria, Class: Alphaproteobacteria, Order: Caulobacterales, Family: Caulobacteraceae, Genus:
atacgaagggggctagcgttgctcggaattactgggcgtaaagggagcgtaggcggacatttaagtcaggggtgaaatcccggggctcaacctcggaattgcctttgatactgggtgtcttgagtatgagagaggtgtgtggaactccgagtgtagaggtgaaattcgtagatattcggaagaacaccagtggcgaaggcgacacactggctcattactgacgctgaggctcgaaagcgtggggagcaaacagg

SEQ ID NO: 624 - DNA, 254 bp, Unknown
  Kingdom: Bacteria, Phylum: Proteobacteria, Class: Alphaproteobacteria, Order: Caulobacterales, Family: Caulobacteraceae, Genus:
atacgaagggggctagcgttgctcggaattactgggcgtaaagggagcgtaggcgggttatcaagttggaggtgaaagcccagggctcaaccttggaattgccttcaaaactgataacctagaggatgatagaggtaagtggaactccgagtgtagaggtgaaattcgtagatattcggaagaacaccagtggcgaaggcgacttactggatcattactgacgctgaggctcgaaagcgtggggagcaaacagg

SEQ ID NO: 625 - DNA, 254 bp, Unknown
  Kingdom: Bacteria, Phylum: Proteobacteria, Class: Alphaproteobacteria, Order: Caulobacterales, Family: Caulobacteraceae, Genus:
atacgaagggggctagcgttgctcggaattactgggcgtaaagggagcgtaggcggacatttaagtcaggggtgaaatcccagagctcaactctggaactgcctttgatactgggtgtcttgagtgtgagagaggtatgtggaactccgagtgtagaggtgaaattcgtagatattcggaagaacaccagtggcgaaggcgacatactggctcattactgacgctgaggctcgaaagcgtggggagcaaacagg

SEQ ID NO: 626 - DNA, 254 bp, Unknown
  Kingdom: Bacteria, Phylum: Proteobacteria, Class: Alphaproteobacteria, Order: Caulobacterales, Family: Caulobacteraceae, Genus:
atacgaagggggctagcgttgctcggaattactgggcgtaaagggagcgtaggcggacatttaagtcagaggtgaaatcccggagcttaacttcggaactgcctttgatactgggtgtcttgagtgtgagagaggtatgtggaactccgagtgtagaggtgaaattcgtagatattcggaagaacaccagtggcgaaggcgacatactggctcattactgacgctgaggctcgaaagcgtggggagcaaacagg

SEQ ID NO: 627 - DNA, 254 bp, Unknown
  Kingdom: Bacteria, Phylum: Proteobacteria, Class: Alphaproteobacteria, Order: Caulobacterales, Family: Caulobacteraceae, Genus:
atacgaagggggctagcgttgctcggaattactgggcgtaaagggagcgtaggcggacatttaagtcaggggtgaaatcccagagctcaactctggaactgcctttgatactggatgtcttgagtgtgagagaggtatgtggaactccgagtgtagaggtgaaattcgtagatattcggaagaacaccagtggcgaaggcgacatactggctcattactgacgctgaggctcgaaagcgtggggagcaaacagg

SEQ ID NO: 628 - DNA, 254 bp, Unknown
  Kingdom: Bacteria, Phylum: Proteobacteria, Class: Alphaproteobacteria, Order: Caulobacterales, Family: Caulobacteraceae, Genus:
atacgaagggggctagcgttgctcggaattactgggcgtaaagggcgcgtaggcggatagtttagtcagaggtgaaagcccagggctcaaccttggaaatgcctttgatactggctatcttgagtacgggagaggtgtgtggaactccgagtgtagaggtgaaattcgtagatattcggaagaacaccggtggcgaaggcgacacactggcccgttactgacgctgaggcgcgaaagcgtggggagcaaacagg

SEQ ID NO: 629 - DNA, 254 bp, Unknown
  Kingdom: Bacteria, Phylum: Proteobacteria, Class: Alphaproteobacteria, Order: Caulobacterales, Family: Caulobacteraceae, Genus:
atacgaagggggctagcgttgctcggaattactgggcgtaaagggagcgtaggcggatagttcagtcagaggtgaaagcccagggctcaaccttggaactgcctttgatactggctatcttgagtttgggagaggtgtgtggaactccgagtgtagaggtgaaattcgtagatattcggaagaacaccagtggcgaaggcgacacactggcccaatactgacgctgaggctcgaaagcgtggggagcaaacagg

SEQ ID NO: 630 - DNA, 254 bp, Unknown
  Kingdom: Bacteria, Phylum: Proteobacteria, Class: Alphaproteobacteria, Order: Caulobacterales, Family: Caulobacteraceae, Genus:
atacgaagggggctagcgttgctcggaattactgggcgtaaagggagcgtaggcgggttatcaagttggaggtgaaagcccagggctcaaccctggaattgccttcaaaactgatagccttgagtatggaagaggtaagtggaactccgagtgtagaggtgaaattcgtagatattcggaagaacaccagtggcgaaggcgacttactggtccatgactgacgctgaggctcgaaagcgtggggagcaaacagg

SEQ ID NO: 631 - DNA, 254 bp, Unknown
  Kingdom: Bacteria, Phylum: Proteobacteria, Class: Alphaproteobacteria, Order: Caulobacterales, Family: Caulobacteraceae, Genus:
atacgaagggggctagcgttgctcggaattactgggcgtaaagggagcgtaggcggatagtttagtcagaggtgaaagcccagggctcaaccttggaattgcctttgatactggctatcttgagtatggaagaggtatgtggaactccgagtgtagaggtgaaattcgtagatattcggaagaacaccagtggcgaaggcgacatactggtccattactgacgctgaggctcgaaagcgtggggagcaaacagg

SEQ ID NO: 632 - DNA, 254 bp, Unknown
  Kingdom: Bacteria, Phylum: Proteobacteria, Class: Alphaproteobacteria, Order: Caulobacterales, Family: Caulobacteraceae, Genus:
atacgaagggggctagcgttgctcggaattactgggcgtaaagggagcgtaggcgggttatcaagttggaggtgaaagcccagggctcaaccttggaattgccttcaaaactgatagcctagagtatgatagaggtaagtggaactccgagtgtagaggtgaaattcgtagatattcggaagaacaccagtggcgaaggcgacttactggatcatgactgacgctgaggctcgaaagcgtggggagcaaacagg

SEQ ID NO: 633 - DNA, 251 bp, Unknown
  Kingdom: Bacteria, Phylum: Proteobacteria, Class: Alphaproteobacteria, Order: Ellin329, Family:  , Genus:
tacgaagggggctagcgttgttcggaattactgggcgtaaagcgcgcgcaggcggctatccaagtcagtggtgaaagcccggagctcaactccggaactgccattgaaactgtttagcttgagtatgagagaggtgagtggaattcccagtgtagaggtgaaattcgtagatattgggaagaacaccggtggcgaaggcggctcactggctcaactgacgctcaggcgcgacagcgtggggatcaaacagg

SEQ ID NO: 634 - DNA, 251 bp, Unknown
  Kingdom: Bacteria, Phylum: Proteobacteria, Class: Alphaproteobacteria, Order: Ellin329, Family:  , Genus:
tacgaagggggctagcgttgttcggaattactgggcgtaaagcgcgcgcaggcggtttttcaagtcagtggtgaaagcccggagctcaactccggaactgccattgaaactgtgaaacttgaggacgagagaggtgagtggaattcccagtgtagaggtgaaattcgtagatattgggaagaacaccggtggcgaaggcggctcactggctcgtctgacgctcaggcgcgacagcgtggggatcaaacagg

SEQ ID NO: 635 - DNA, 254 bp, Unknown
  Kingdom: Bacteria, Phylum: Proteobacteria, Class: Alphaproteobacteria, Order: Rhizobiales, Family: 1174-901-12, Genus:
atacgaagggggctagcgttgttcggaatcactgggcgtaaagggtgcgtaggcgggatcttaagtcaggggtgaaatcccgaggctcaacctcggaactgcctttgatactggggtccttgagtccggaagaggtgagtggaactgcgagtgtagaggtgaaattcgtagatattcgcaagaacaccggtggcgaaggcggctcactggtccggaactgacgctgaggcacgacagcgtggggagcaaacagg

SEQ ID NO: 636 - DNA, 254 bp, Unknown
  Kingdom: Bacteria, Phylum: Proteobacteria, Class: Alphaproteobacteria, Order: Rhizobiales, Family: 1174-901-12, Genus:
atacgaagggggctagcgttgttcggatttactgggcgtaaagggcgcgtaggcgggcgattaagtcaggggtgaaatcccaaggctcaaccttggaactgcctttgatactgattgtcttgagtccgggagaggtgagtggaactgcgagtgtagaggtgaaattcgtagatattcgcaagaacaccagtggcgaaggcggctcactggcccggaactgacgctgaggcgcgaaagcgtggggagcaaacagg

SEQ ID NO: 637 - DNA, 254 bp, Unknown
  Kingdom: Bacteria, Phylum: Proteobacteria, Class: Alphaproteobacteria, Order: Rhizobiales, Family: 1174-901-12, Genus:
atacgaagggggctagcgttgttcggatttactgggcgtaaagggcgcgtaggcgggcgattaagtcaggggtgaaatcccacagctcaactgtggaactgcctttgatactggttgtcttgagtccgggagaggtgagtggaactgcgagtgtagaggtgaaattcgtagatattcgcaagaacaccagtggcgaaggcggctcactggcccggaactgacgctgaggcgcgaaagcgtggggagcaaacagg

SEQ ID NO: 638 - DNA, 254 bp, Unknown
  Kingdom: Bacteria, Phylum: Proteobacteria, Class: Alphaproteobacteria, Order: Rhizobiales, Family: alphaI_cluster, Genus:
atacgaagggggctagcgttgttcggaattactgggcgtaaagcgcgtgtaggcgggtctttaagtcaggggtgaaatgccaaggctcaaccttggaactgcctttgatactggagatcttgagtccgggagaggtgagtggaattgcgagtgtagaggtgaaattcgtagatattcgcaagaacaccagtggcgaaggcggctcactggcccggaactgacgctgagacgcgaaagcgtggggagcaaacagg

SEQ ID NO: 639 - DNA, 254 bp, Unknown
  Kingdom: Bacteria, Phylum: Proteobacteria, Class: Alphaproteobacteria, Order: Rhizobiales, Family: Aurantimonadaceae, Genus:
atacgaagggggctagcgttgttcggaattactgggcgtaaagcgcacgtaggcggacatttaagtcaggggtgaaatcccggggctcaaccccggaactgcctttgatactgggtgtcttgagtgtggtagaggtgagtggaattgcgagtgtagaggtgaaattcgtagatattcgcaggaacaccggtggcgaaggcggctcactggaccacaactgacgctgaggtgcgaaagcgtggggagcaaacagg

SEQ ID NO: 640 - DNA, 254 bp, Unknown
  Kingdom: Bacteria, Phylum: Proteobacteria, Class: Alphaproteobacteria, Order: Rhizobiales, Family: Aurantimonadaceae, Genus:
atacgaagggggctagcgttgttcggaattactgggcgtaaagcgcacgtaggcggacatttaagtcaggggtgaaatcccggggctcaaccccggaactgcctttgatactgggtgtcttgagtgtggtagaggtgagtggaattgcgagtgtagaggtgaaattcgtagatattcgcaggaacaccagtggcgaaggcggctcactggaccacaactgacgctgaggtgcgaaagcgtggggagcaaacagg

SEQ ID NO: 641 - DNA, 251 bp, Unknown
  Kingdom: Bacteria, Phylum: Proteobacteria, Class: Alphaproteobacteria, Order: Rhizobiales, Family: Aurantimonadaceae, Genus:
tacgaagggggctagcgttgttcggaattactgggcgtaaagcgcacgtaggcggatatttaagtcaggggtgaaatcccggggctcaaccccggaacggcctttgatactggatgtcttgagtccggaagaggtgagtggaattgcgagtgtagaggtgaaattcgtagatattcgcaggaacaccagtggcgaaggcggctcactggtccgactgacgctgaggtgcgaaagcgtggggagcaaacagg

SEQ ID NO: 642 - DNA, 254 bp, Unknown
  Kingdom: Bacteria, Phylum: Proteobacteria, Class: Alphaproteobacteria, Order: Rhizobiales, Family: Aurantimonadaceae, Genus:
atacgaagggggctagcgttgttcggaattactgggcgtaaagcgcacgtaggcggacatttaagtcaggggtgaaatcccggggctcaaccccggaactgcctttgatactgggtgtcttgagttcggaagaggtgagtggaattgcgagtgtagaggtgaaattcgtagatattcgcaggaacaccagtggcgaaggcggctcactggtccgatactgacgctgaggtgcgaaagcgtggggagcaaacagg

SEQ ID NO: 643 - DNA, 254 bp, Unknown
  Kingdom: Bacteria, Phylum: Proteobacteria, Class: Alphaproteobacteria, Order: Rhizobiales, Family: Aurantimonadaceae, Genus:
atacgaagggggctagcgttgttcggaattactgggcgtaaagcgcacgtaggcggacatttaagtcaggggtgaaatcccggggctcaaccccggaactgcctttgatactgggtgtcttgagtccggaagaggtgagtggaattgcgagtgtagaggtgaaattcgtagatattcgcaggaacaccagtggcgaaggcggctcactggtccggtactgacgctgaggtgcgaaagcgtggggagcaaacagg

SEQ ID NO: 644 - DNA, 254 bp, Unknown
  Kingdom: Bacteria, Phylum: Proteobacteria, Class: Alphaproteobacteria, Order: Rhizobiales, Family: Aurantimonadaceae, Genus:
atacgaagggggctagcgttgttcggaattactgggcgtaaagcgcacgtaggcggacatttaagtcaggggtgaaatcccggggctcaaccccggaacggcctttgatactgggtgtcttgagttcggaagaggtgagtggaattgcgagtgtagaggtgaaattcgtagatattcgcaggaacaccagtggcgaaggcggctcactggtccgatactgacgctgaggtgcgaaagcgtggggagcaaacagg

SEQ ID NO: 645 - DNA, 254 bp, Unknown
  Kingdom: Bacteria, Phylum: Proteobacteria, Class: Alphaproteobacteria, Order: Rhizobiales, Family: Bradyrhizobiaceae, Genus:
atacgaagggggctagcgttgctcggaatcactgggcgtaaagggcgcgtaggcggccgatcaagtcaggggtgaaagcctgtggctcaaccacagaattgcctttgatactgttcggctcgagaccggaagaggttggtggaactgcgagtgtagaggtgaaattcgtagatattcgcaagaacaccagtggcgaaggcggccaactggtccggttctgacgctgaggcgcgaaagcgtggggagcaaacagg

SEQ ID NO: 646 - DNA, 254 bp, Unknown
  Kingdom: Bacteria, Phylum: Proteobacteria, Class: Alphaproteobacteria, Order: Rhizobiales, Family: Bradyrhizobiaceae, Genus:
atacgaagggggctagcgttgctcggaatcactgggcgtaaagggtgcgtaggcgggtctttaagtcagaggtgaaagcctggagctcaactccagaactgcctttgatactgaggatctcgagttcgggagaggtgagtggaactgcgagtgtagaggtgaaattcgtagatattcgcaagaacaccagtggcgaaggcggctcactggcccgatactgacgctgaggcacgaaagcgtggggagcaaacagg

SEQ ID NO: 647 - DNA, 254 bp, Unknown
  Kingdom: Bacteria, Phylum: Proteobacteria, Class: Alphaproteobacteria, Order: Rhizobiales, Family: Bradyrhizobiaceae, Genus:
atacgaagggggctagcgttgctcggaatcactgggcgtaaagggtgcgtaggcgggtttttaagtcagaggtgaaatcctggagctcaactccagaactgcctttgatactgaaagtcttgagtatgggagaggtgagtggaactgcgagtgtagaggtgaaattcgtagatattcgcaagaacaccagtggcgaaggcggctcactggcccataactgacgctgaggcacgaaagcgtggggagcaaacagg

SEQ ID NO: 648 - DNA, 254 bp, Unknown
  Kingdom: Bacteria, Phylum: Proteobacteria, Class: Alphaproteobacteria, Order: Rhizobiales, Family: Bradyrhizobiaceae, Genus:
atacgaagggggctagcgttgctcggaatcactgggcgtaaagggtgcgtaggcgggtctttaagtcaggggtgaaatcctggagctcaactccagaactgcctttgatactgaagatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacagg

SEQ ID NO: 649 - DNA, 254 bp, Unknown
  Kingdom: Bacteria, Phylum: Proteobacteria, Class: Alphaproteobacteria, Order: Rhizobiales, Family: Bradyrhizobiaceae, Genus:
atacgaagggggctagcgttgctcggaatcactgggcgtaaagggtgcgtaggcgggtctttaagtcagaggtgaaatcctggagctcaactccagaactgcctttgatactgaggatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacagg

SEQ ID NO: 650 - DNA, 254 bp, Unknown
  Kingdom: Bacteria, Phylum: Proteobacteria, Class: Alphaproteobacteria, Order: Rhizobiales, Family: Bradyrhizobiaceae, Genus:
atacgaagggggctagcgttgctcggaatcactgggcgtaaagggtgcgtaggcgggtttttaagtcagaggtgaaatcctggagctcaactccagaactgcctttgatactgggaatcttgagtatggaagaggtgagtggaactgcgagtgtagaggtgaaattcgtagatattcgcaagaacaccagtggcgaaggcggctcactggtccataactgacgctgaggcacgaaagcgtggggagcaaacagg

SEQ ID NO: 651 - DNA, 254 bp, Unknown
  Kingdom: Bacteria, Phylum: Proteobacteria, Class: Alphaproteobacteria, Order: Rhizobiales, Family: Bradyrhizobiaceae, Genus:
atacgaagggggctagcgttgctcggaatcactgggcgtaaagggtgcgtaggcgggtttttaagtcaggggtgaaatcctggagctcaactccagaactgcctttgatactgaagatcttgagtccggaagaggtgagtggaactgcgagtgtagaggtgaaattcgtagatattcgcaagaacaccagtggcgaaggcggctcactggtccggtactgacgctgaggcacgaaagcgtggggagcaaacagg

SEQ ID NO: 652 - DNA, 251 bp, Unknown
  Kingdom: Bacteria, Phylum: Proteobacteria, Class: Alphaproteobacteria, Order: Rhizobiales, Family: Bradyrhizobiaceae, Genus:
tacgaagggggctagcgttgctcggaatcactgggcgtaaagggtgcgtaggcgggtttttaagtcagaggtgaaatcctggagctcaactccagaactgcctttgatactgggaatcttgagtatggaagaggtgagtggaactgcgagtgtagaggtgaaattcgtagatattcgcaagaacaccagtggcgaaggcggctcactggtccaactgacgctgaggcacgaaagcgtggggagcaaacagg

SEQ ID NO: 653 - DNA, 254 bp, Unknown
  Kingdom: Bacteria, Phylum: Proteobacteria, Class: Alphaproteobacteria, Order: Rhizobiales, Family: Bradyrhizobiaceae, Genus:
atacgaagggggctagcgttgctcggaatcactgggcgtaaagggtgcgtaggcgggtttttaagtcaggggtgaaatcctggagctcaactccagaactgcctttgatactgaagatcttgagtccgggagaggtgagtggaactgcgagtgtagaggtgaaattcgtagatattcgcaagaacaccagtggcgaaggcggctcactggcccggtactgacgctgaggcacgaaagcgtggggagcaaacagg

SEQ ID NO: 654 - DNA, 254 bp, Unknown
  Kingdom: Bacteria, Phylum: Proteobacteria, Class: Alphaproteobacteria, Order: Rhizobiales, Family: Bradyrhizobiaceae, Genus:
atacgaagggggctagcgttgctcggaatcactgggcgtaaagggtgcgtaggcgggtctttaagtcaggggtgaaatcctggagctcaactccagaactgcctttgatactgaagatcttgagtccgggagaggtgagtggaactgcgagtgtagaggtgaaattcgtagatattcgcaagaacaccagtggcgaaggcggctcactggcccggtactgacgctgaggcacgaaagcgtggggagcaaacagg

SEQ ID NO: 655 - DNA, 254 bp, Unknown
  Kingdom: Bacteria, Phylum: Proteobacteria, Class: Alphaproteobacteria, Order: Rhizobiales, Family: Bradyrhizobiaceae, Genus:
atacgaagggggctagcgttgctcggaatcactgggcgtaaagcgcacgtaggcggactcttaagtcggtggtgaaatcctggagctcaactccagaactgccttcgatactgggagtctcgagttcgggagaggtgagtggaactgcgagtgtagaggtgaaattcgtagatattcgcaagaacaccagtggcgaaggcggctcactggcccgatactgacgctgaggtgcgaaagcgtggggagcaaacagg

SEQ ID NO: 656 - DNA, 254 bp, Unknown
  Kingdom: Bacteria, Phylum: Proteobacteria, Class: Alphaproteobacteria, Order: Rhizobiales, Family: Bradyrhizobiaceae, Genus:
atacgaagggggctagcgttgctcggaatcactgggcgtaaagggtgcgtaggcgggtctttaagtcaggggtgaaatcctggagctcaactccagaactgcctttgatactgaggatcttgagttcgggagaggtgagtggaactgcgagtgtagaggtgaaattcgtagatattcgcaagaacaccagtggcgaaggcggctcactggcccgatactgacgctgaggcacgaaagcgtggggagcaaacagg

SEQ ID NO: 657 - DNA, 254 bp, Unknown
  Kingdom: Bacteria, Phylum: Proteobacteria, Class: Alphaproteobacteria, Order: Rhizobiales, Family: Bradyrhizobiaceae, Genus:
atacgaagggggctagcgttgctcggaatcactgggcgtaaagggtgcgtaggcgggtctttaagtcaggggtgaaatcctggagctcaactccagaactgcctttgatactgaagatcttgagtatgggagaggtgagtggaactgcgagtgtagaggtgaaattcgtagatattcgcaagaacaccagtggcgaaggcggctcactggcccataactgacgctgaggcacgaaagcgtggggagcaaacagg

SEQ ID NO: 658 - DNA, 254 bp, Unknown
  Kingdom: Bacteria, Phylum: Proteobacteria, Class: Alphaproteobacteria, Order: Rhizobiales, Family: Brucellaceae, Genus:
atacgaagggggctagcgttgttcggaattactgggcgtaaagcgcacgtaggcgggtatttaagtcaggggtgaaatcccagagctcaactctggaactgcctttgatactgggtacctagagtatggaagaggtgagtggaattccgagtgtagaggtgaaattcgtagatattcggaggaacaccagtggcgaaggcggctcactggtccattactgacgctgaggtgcgaaagcgtggggagcaaacagg

SEQ ID NO: 659 - DNA, 254 bp, Unknown
  Kingdom: Bacteria, Phylum: Proteobacteria, Class: Alphaproteobacteria, Order: Rhizobiales, Family: F0723, Genus:
atacgaagggggctagcgttgctcggaatcactgggcgtaaagcgcacgtaggcggatctttaagtcaggggtgaaatcccaaggctcaaccttggaactgcctttgatactggggatctcgagtccggaagaggttggtggaactgcgagtgtagaggtgaaattcgtagatattcgcaagaacaccagtggcgaaggcggccaactggtccggtactgacgctgaggtgcgaaagcgtggggagcaaacagg

SEQ ID NO: 660 - DNA, 254 bp, Unknown
  Kingdom: Bacteria, Phylum: Proteobacteria, Class: Alphaproteobacteria, Order: Rhizobiales, Family: F0723, Genus:
atacgaagggggctagcgttgttcggaatcactgggcgtaaagcgcacgtaggcggaccattaagtcaggggtgaaagcctggagctcaactccagaactgcctttgatactgatggtctcgagtatggaagaggttggtggaactgcgagtgtagaggtgaaattcgtagatattcgcaagaacaccagtggcgaaggcggccaactggtccattactgacgctgaggtgcgaaagcgtggggagcaaacagg

SEQ ID NO: 661 - DNA, 253 bp, Unknown
  Kingdom: Bacteria, Phylum: Proteobacteria, Class: Alphaproteobacteria, Order: Rhizobiales, Family: Hyphomicrobiaceae, Genus: Devosia
atacgaaggggctagcgttgttcggatttactgggcgtaaagcgcacgtaggcggatcgttaagtcgggggtgaaatcccggggctcaaccccggaactgccttcgatactggcgatcttgagtccggaagaggtgagtggaactcctagtgtagaggtggaattcgtagatattaggaagaacaccagtggcgaaggcggctcactggtccggtactgacgctgaggtgcgaaagcgtggggagcaaacagg

SEQ ID NO: 662 - DNA, 254 bp, Unknown
  Kingdom: Bacteria, Phylum: Proteobacteria, Class: Alphaproteobacteria, Order: Rhizobiales, Family: Hyphomicrobiaceae, Genus: Devosia
atacgaagggggctagcgttgttcggatttactgggcgtaaagcgcacgtaggcggattgttaagtcaggggtgaaatcctggagctcaactccagaactgcctttgatactggcaatctcgagtccggaagaggtaagtggaactcctagtgtagaggtggaattcgtagatattaggaagaacaccagtggcgaaggcggcttactggtccggaactgacgctgaggtgcgaaagcgtggggagcaaacagg

SEQ ID NO: 663 - DNA, 254 bp, Unknown
  Kingdom: Bacteria, Phylum: Proteobacteria, Class: Alphaproteobacteria, Order: Rhizobiales, Family: Hyphomicrobiaceae, Genus:
atacgaagggggctagcgttgttcggatttactgggcgtaaagcgcacgtaggcggtttgttaagtcagaggtgaaatcccggagctcaactccggaactgcctttgatactggcaagctagagtccggaagaggtaagtggaactcctagtgtagaggtggaattcgtagatattaggaagaacaccagtggcgaaggcggcttactggtccggaactgacgctgaggtgcgaaagcgtggggagcaaacagg

SEQ ID NO: 664 - DNA, 254 bp, Unknown
  Kingdom: Bacteria, Phylum: Proteobacteria, Class: Alphaproteobacteria, Order: Rhizobiales, Family: Hyphomicrobiaceae, Genus:
atacgaagggggctagcgttgttcggatttactgggcgtaaagcgcacgtaggcggattgttaagtcaggggtgaaatcctggagctcaactccagaactgcctttgatactggcaatctcgagtccggaagaggtgagtggaactcctagtgtagaggtggaattcgtagatattaggaagaacaccagtggcgaaggcggctcactggtccggtactgacgctgaggtgcgaaagcgtggggagcaaacagg

SEQ ID NO: 665 - DNA, 251 bp, Unknown
  Kingdom: Bacteria, Phylum: Proteobacteria, Class: Alphaproteobacteria, Order: Rhizobiales, Family: Hyphomicrobiaceae, Genus:
tacgaagggggctagcgttgttcggatttactgggcgtaaagcgcacgtaggcggatcgttaagtcgggggtgaaatcctggagctcaactccagaactgccttcgatactggcgatcttgagtccggaagaggtgagtggaactcctagtgtagaggtggaattcgtagatattaggaagaacaccagtggcgaaggcggctcactggtccgactgacgctgaggtgcgaaagcgtggggagcaaacagg

SEQ ID NO: 666 - DNA, 254 bp, Unknown
  Kingdom: Bacteria, Phylum: Proteobacteria, Class: Alphaproteobacteria, Order: Rhizobiales, Family: Hyphomicrobiaceae, Genus:
atacgaagggggctagcgttgttcggatttactgggcgtaaagcgcacgtaggcggattggtcagttaggggtgaaatcccagagctcaactctggaactgcctttaatactgccagtctagagtccggaagaggtaagtggaactcctagtgtagaggtggaattcgtagatattaggaagaacaccagtggcgaaggcggcttactggtccggtactgacgctgaggtgcgaaagcgtggggagcaaacagg

SEQ ID NO: 667 - DNA, 251 bp, Unknown
  Kingdom: Bacteria, Phylum: Proteobacteria, Class: Alphaproteobacteria, Order: Rhizobiales, Family: Hyphomicrobiaceae, Genus:
tacgaagggggctagcgttgttcggatttactgggcgtaaagcgcacgtaggcggattgttaagtgagaggtgaaatcccagagctcaactctggaactgcctttcatactggcaatctagagtccggaagaggtaagtggaactcctagtgtagaggtggaattcgtagatattaggaagaacaccagtggcgaaggcggcttactggtccgactgacgctgaggtgcgaaagcgtggggagcaaacagg

SEQ ID NO: 668 - DNA, 251 bp, Unknown
  Kingdom: Bacteria, Phylum: Proteobacteria, Class: Alphaproteobacteria, Order: Rhizobiales, Family: Hyphomicrobiaceae, Genus:
tacgaagggggctagcgttgttcggatttactgggcgtaaagcgcacgtaggcggtttgttaagtcaggggtgaaatcccagagctcaactctggaactgcctttgatactggcaagctcgagtccggaagaggtaagtggaactcctagtgtagaggtggaattcgtagatattaggaagaacaccagtggcgaaggcggcttactggtccgactgacgctgaggtgcgaaagcgtggggagcaaacagg

SEQ ID NO: 669 - DNA, 254 bp, Unknown
  Kingdom: Bacteria, Phylum: Proteobacteria, Class: Alphaproteobacteria, Order: Rhizobiales, Family: Hyphomicrobiaceae, Genus:
atacgaaggggactagcgttgttcggaatcactgggcgtaaagcgcacgtaggcggatttgtaagtcaggggtgaaatcccggggctcaacctcggaactgcctttgatactgcgagtcttgagtccgatagaggtgggtggaattcctagtgtagaggtgaaattcgtagatattaggaagaacaccggtggcgaaggcggcccactggatcggtactgacgctgaggtgcgaaagcgtggggagcaaacagg

SEQ ID NO: 670 - DNA, 254 bp, Unknown
  Kingdom: Bacteria, Phylum: Proteobacteria, Class: Alphaproteobacteria, Order: Rhizobiales, Family: Hyphomicrobiaceae, Genus:
atacgaaggggactagcgttgttcggaatcactgggcgtaaagcgcacgtaggcggatatgtcagtcaggggtgaaatcccggggctcaacctcggaactgcctttgatacagcatgtcttgagtccgatagaggtgggtggaattcctagtgtagaggtgaaattcgtagatattaggaagaacaccggtggcgaaggcggcccactggatcggtactgacgctgaggtgcgaaagcgtggggagcaaacagg

SEQ ID NO: 671 - DNA, 254 bp, Unknown
  Kingdom: Bacteria, Phylum: Proteobacteria, Class: Alphaproteobacteria, Order: Rhizobiales, Family: Hyphomicrobiaceae, Genus:
atacgaagggggctagcgttgttcggatttactgggcgtaaagcgcacgtaggcggattggtcagttaggggtgaaatcctggagctcaactccagaactgcctttaatactgccagtctcgagtccggaagaggtaagtggaactcctagtgtagaggtggaattcgtagatattaggaagaacaccagtggcgaaggcggcttactggtccggtactgacgctgaggtgcgaaagcgtggggagcaaacagg

SEQ ID NO: 672 - DNA, 254 bp, Unknown
  Kingdom: Bacteria, Phylum: Proteobacteria, Class: Alphaproteobacteria, Order: Rhizobiales, Family: Hyphomicrobiaceae, Genus:
atacgaagggggctagcgttgttcggatttactgggcgtaaagcgcacgtaggcggattggtcagttagaggtgaaatcccgaagctcaacttcggaactgcctttaatactgccaatctagagtccggaagaggtgagtggaactcctagtgtagaggtggaattcgtagatattaggaagaacaccagtggcgaaggcggctcactggtccggtactgacgctgaggtgcgaaagcgtggggagcaaacagg

SEQ ID NO: 673 - DNA, 254 bp, Unknown
  Kingdom: Bacteria, Phylum: Proteobacteria, Class: Alphaproteobacteria, Order: Rhizobiales, Family: Hyphomicrobiaceae, Genus:
atacgaagggggctagcgttgttcggatttactgggcgtaaagcgcacgtaggcggatcgatcagtcaggggtgaaatcctggagctcaactccagaactgcctttgatactgtcgatctcgagtccggaagaggtgagtggaactcctagtgtagaggtggaattcgtagatattaggaagaacaccagtggcgaaggcggctcactggtccggtactgacgctgaggtgcgaaagcgtggggagcaaacagg

SEQ ID NO: 674 - DNA, 251 bp, Unknown
  Kingdom: Bacteria, Phylum: Proteobacteria, Class: Alphaproteobacteria, Order: Rhizobiales, Family: Hyphomicrobiaceae, Genus:
tacgaagggggctagcgttgttcggatttactgggcgtaaagcgcacgtaggcggattgttaagtcgggggtgaaatcctggagctcaactccagaactgccttcgatactggcaatctcgagtccggaagaggtaagtggaactcctagtgtagaggtggaattcgtagatattaggaagaacaccagtggcgaaggcggcttactggtccgactgacgctgaggtgcgaaagcgtggggagcaaacagg

SEQ ID NO: 675 - DNA, 254 bp, Unknown
  Kingdom: Bacteria, Phylum: Proteobacteria, Class: Alphaproteobacteria, Order: Rhizobiales, Family: Hyphomicrobiaceae, Genus:
atacgaagggggctagcgttgttcggatttactgggcgtaaagcgcacgtaggcggtttgttaagtcaggggtgaaatcccggagctcaactccggaactgcctttgatactggcaagctagagtccggaagaggtaagtggaactcctagtgtagaggtggaattcgtagatattaggaagaacaccagtggcgaaggcggcttactggtccggaactgacgctgaggtgcgaaagcgtggggagcaaacagg

SEQ ID NO: 676 - DNA, 254 bp, Unknown
  Kingdom: Bacteria, Phylum: Proteobacteria, Class: Alphaproteobacteria, Order: Rhizobiales, Family: Hyphomicrobiaceae, Genus:
atacgaagggggctagcgttgttcggatttactgggcgtaaagcgcacgtaggcggatcgttaagtcgggggtgaaatcctggagctcaactccagaactgccttcgatactggcgatcttgagtccggaagaggtgagtggaactcctagtgtagaggtggaattcgtagatattaggaagaacaccagtggcgaaggcggctcactggtccggtactgacgctgaggtgcgaaagcgtggggagcaaacagg

SEQ ID NO: 677 - DNA, 254 bp, Unknown
  Kingdom: Bacteria, Phylum: Proteobacteria, Class: Alphaproteobacteria, Order: Rhizobiales, Family: Hyphomicrobiaceae, Genus:
atacgaagggggctagcgttgttcggatttactgggcgtaaagcgcacgtaggcggattgttaagtcaggggtgaaatcctggagctcaactccagaactgcctttgatactggcaatctagagtccggaagaggtgagtggaactcctagtgtagaggtggaattcgtagatattaggaagaacaccagtggcgaaggcggctcactggtccggtactgacgctgaggtgcgaaagcgtggggagcaaacagg

SEQ ID NO: 678 - DNA, 254 bp, Unknown
  Kingdom: Bacteria, Phylum: Proteobacteria, Class: Alphaproteobacteria, Order: Rhizobiales, Family: Hyphomicrobiaceae, Genus:
atacgaagggggctagcgttgttcggatttactgggcgtaaagcgcacgtaggcggatcgttaagtcgggggtgaaatcctggagctcaactccagaactgccttcgatactggcgatctagagtccggaagaggtgagtggaactcctagtgtagaggtggaattcgtagatattaggaagaacaccagtggcgaaggcggctcactggtccggtactgacgctgaggtgcgaaagcgtggggagcaaacagg

SEQ ID NO: 679 - DNA, 254 bp, Unknown
  Kingdom: Bacteria, Phylum: Proteobacteria, Class: Alphaproteobacteria, Order: Rhizobiales, Family: Methylobacteriaceae, Genus:
atacgaagggggctagcgttgctcggaatcactgggcgtaaagggcgcgtaggcggctgatttagtcgagggtgaaagcccgtggctcaaccacggaatggccttcgatactgattggctcgagaccggaagaggacagcggaactgcgagtgtagaggtgaaattcgtagatattcgcaagaacaccagtggcgaaggcggctgtctggtccggttctgacgctgaggcgcgaaagcgtggggagcaaacagg

SEQ ID NO: 680 - DNA, 254 bp, Unknown
  Kingdom: Bacteria, Phylum: Proteobacteria, Class: Alphaproteobacteria, Order: Rhizobiales, Family: Methylobacteriaceae, Genus:
atacgaagggggctagcgttgttcggaatcactgggcgtaaagggcgcgtaggcggctttgtaagtcgggggtgaaagcctgtggctcaaccacagaattgccttcgatactgcatggcttgagaccggaagaggttagtggaactgcgagtgtagaggtgaaattcgtagatattcgcaagaacaccagtggcgaaggcggctgactggtccggttctgacgctgaggcgcgaaagcgtggggagcaaacagg

SEQ ID NO: 681 - DNA, 254 bp, Unknown
  Kingdom: Bacteria, Phylum: Proteobacteria, Class: Alphaproteobacteria, Order: Rhizobiales, Family: Methylobacteriaceae, Genus:
atacgaagggggctagcgttgctcggaatcactgggcgtaaagggcgcgtaggcggccgattaagtcgggggtgaaagcctgtggctcaaccacagaattgccttcgatactggttggcttgagaccggaagaggacagcggaactgcgagtgtagaggtgaaattcgtagatattcgcaagaacaccagtggcgaaggcggctgtctggtccggttctgacgctgaggcgcgaaagcgtggggagcaaacagg

SEQ ID NO: 682 - DNA, 254 bp, Unknown
  Kingdom: Bacteria, Phylum: Proteobacteria, Class: Alphaproteobacteria, Order: Rhizobiales, Family: Methylobacteriaceae, Genus:
atacgaagggggctagcgttgctcggaatcactgggcgtaaagggcgcgtaggcggccattcaagtcgggggtgaaagcctgtggctcaaccacagaattgccttcgatactgtttggcttgagtatggtagaggtcagtggaactgcgagtgtagaggtgaaattcgtagatattcgcaagaacaccagtggcgaaggcggctgactggaccattactgacgctgaggcgcgaaagcgtggggagcaaacagg

SEQ ID NO: 683 - DNA, 251 bp, Unknown
  Kingdom: Bacteria, Phylum: Proteobacteria, Class: Alphaproteobacteria, Order: Rhizobiales, Family: Methylobacteriaceae, Genus:
tacgaagggggctagcgttgctcggaatcactgggcgtaaagggcgcgtaggcggctgatttagtcgagggtgaaagcccgtggctcaaccacggaatggccttcgatactggttggcttgagaccggaagaggacagcggaactgcgagtgtagaggtgaaattcgtagatattcgcaagaacaccagtggcgaaggcggctgtctggtccgtctgacgctgaggcgcgaaagcgtggggagcaaacagg

SEQ ID NO: 684 - DNA, 254 bp, Unknown
  Kingdom: Bacteria, Phylum: Proteobacteria, Class: Alphaproteobacteria, Order: Rhizobiales, Family: Methylobacteriaceae, Genus:
atacgaagggggctagcgttgctcggaatcactgggcgtaaagggcgcgtaggcggcgttttaagtcgggggtgaaagcctgtggctcaaccacagaatggccttcgatactgggacgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacagg

SEQ ID NO: 685 - DNA, 254 bp, Unknown
  Kingdom: Bacteria, Phylum: Proteobacteria, Class: Alphaproteobacteria, Order: Rhizobiales, Family: Methylobacteriaceae, Genus:
atacgaagggggctagcgttgttcggaatcactgggcgtaaagggcgcgtaggcggccgattaagtcgggggtgaaagcctgtggctcaaccacagaattgccttcgatactgattggcttgagaccggaagaggtcagtggaactgcgagtgtagaggtgaaattcgtagatattcgcaagaacaccagtggcgaaggcggctgactggtccggttctgacgctgaggcgcgaaagcgtggggagcaaacagg

SEQ ID NO: 686 - DNA, 254 bp, Unknown
  Kingdom: Bacteria, Phylum: Proteobacteria, Class: Alphaproteobacteria, Order: Rhizobiales, Family: Methylobacteriaceae, Genus:
atacgaagggggctagcgttgctcggaatcactgggcgtaaagggcgcgtaggcggcgttttaagtcgggggtgaaagcctgtggctcaaccacagaatggccttcgatactggggcgcttgagtatggtagaggttggtggaactgcgagtgtagaggtgaaattcgtagatattcgcaagaacaccggtggcgaaggcggccaactggaccattactgacgctgaggcgcgaaagcgtggggagcaaacagg

SEQ ID NO: 687 - DNA, 251 bp, Unknown
  Kingdom: Bacteria, Phylum: Proteobacteria, Class: Alphaproteobacteria, Order: Rhizobiales, Family: Methylobacteriaceae, Genus:
tacgaagggggctagcgttgctcggaatcactgggcgtaaagggcgcgtaggcggctgacttagtcgagggtgaaagcccgtggctcaaccacggaatggccttcgatactggttggcttgagaccggaagaggacagcggaactgcgagtgtagaggtgaaattcgtagatattcgcaagaacaccagtggcgaaggcggctgtctggtccgtctgacgctgaggcgcgaaagcgtggggagcaaacagg

SEQ ID NO: 688 - DNA, 254 bp, Unknown
  Kingdom: Bacteria, Phylum: Proteobacteria, Class: Alphaproteobacteria, Order: Rhizobiales, Family: Methylobacteriaceae, Genus:
atacgaagggggctagcgttgctcggaatcactgggcgtaaagggcgcgtaggcggctgatttagtcgagggtgaaagcccgtggctcaaccacggaatggccttcgatactggttggcttgagaccggaagaggacagcggaactgcgagtgtagaggtgaaattcgtagatattcgcaagaacaccagtggcgaaggcggctgtctggtccggttctgacgctgaggcgcgaaagcgtggggagcaaacagg

SEQ ID NO: 689 - DNA, 254 bp, Unknown
  Kingdom: Bacteria, Phylum: Proteobacteria, Class: Alphaproteobacteria, Order: Rhizobiales, Family: Methylobacteriaceae, Genus:
atacgaagggggctagcgttgctcggaatcactgggcgtaaagggcgcgtaggcggctgatttagtcgagggtgaaagcccgtggctcaaccacggaatggccttcgatactgattggcttgagaccggaagaggacagcggaactgcgagtgtagaggtgaaattcgtagatattcgcaagaacaccagtggcgaaggcggctgtctggtccggttctgacgctgaggcgcgaaagcgtggggagcaaacagg

SEQ ID NO: 690 - DNA, 254 bp, Unknown
  Kingdom: Bacteria, Phylum: Proteobacteria, Class: Alphaproteobacteria, Order: Rhizobiales, Family: Methylobacteriaceae, Genus:
atacgaagggggctagcgttgttcggaatcactgggcgtaaagggcgcgtaggcggctttgtaagtcgggggtgaaagcctgtggctcaaccacagaattgccttcgatactgcatggcttgagaccggaagaggtaagtggaactgcgagtgtagaggtgaaattcgtagatattcgcaagaacaccagtggcgaaggcggcttactggtccggttctgacgctgaggcgcgaaagcgtggggagcaaacagg

SEQ ID NO: 691 - DNA, 251 bp, Unknown
  Kingdom: Bacteria, Phylum: Proteobacteria, Class: Alphaproteobacteria, Order: Rhizobiales, Family: Methylobacteriaceae, Genus:
tacgaagggggctagcgttgctcggaatcactgggcgtaaagggcgcgtaggcggtcttttaagtcgggggtgaaagcctgtggctcaaccacagaattgccttcgatactgggagacttgagttcggaagaggttggtggaactgcgagtgtagaggtgaaattcgtagatattcgcaagaacaccggtggcgaaggcggccaactggtccgactgacgctgaggcgcgaaagcgtggggagcaaacagg

SEQ ID NO: 692 - DNA, 254 bp, Unknown
  Kingdom: Bacteria, Phylum: Proteobacteria, Class: Alphaproteobacteria, Order: Rhizobiales, Family: Methylobacteriaceae, Genus:
atacgaagggggctagcgttgttcggaatcactgggcgtaaagggcgcgtaggcggcttgataagtcgggggtgaaagcctgtggctcaaccacagaattgccttcgatactgtctggcttgagaccggaagaggtaagtggaactgcgagtgtagaggtgaaattcgtagatattcgcaagaacaccagtggcgaaggcggcttactggtccggttctgacgctgaggcgcgaaagcgtggggagcaaacagg

SEQ ID NO: 693 - DNA, 251 bp, Unknown
  Kingdom: Bacteria, Phylum: Proteobacteria, Class: Alphaproteobacteria, Order: Rhizobiales, Family: Methylobacteriaceae, Genus:
tacgaagggggctagcgttgctcggaatcactgggcgtaaagggcgcgtaggcggctgatttagtcgagggtgaaagcccgtggctcaaccacggaatggccttcgatactgattggctcgagaccggaagaggacagcggaactgcgagtgtagaggtgaaattcgtagatattcgcaagaacaccagtggcgaaggcggctgtctggtccgtctgacgctgaggcgcgaaagcgtggggagcaaacagg

SEQ ID NO: 694 - DNA, 255 bp, Unknown
  Kingdom: Bacteria, Phylum: Proteobacteria, Class: Alphaproteobacteria, Order: Rhizobiales, Family: Methylobacteriaceae, Genus:
atacgaagggggctagcgttgctcggaatcactgggcgtaaagcgcacgtaggtgggtcgttaagtcgggggtgaaatcccagagctcaactctggaactgccttcgatactggcgaccttcgagttcgggagaggtgagtggaactgcgagtgtagaggtgaaattcgtagatattcgcaagaacaccagtggcgaaggcggctcactggcccgatactgacactgaggtgcgaaagcgtggggagcaaacagg

SEQ ID NO: 695 - DNA, 254 bp, Unknown
  Kingdom: Bacteria, Phylum: Proteobacteria, Class: Alphaproteobacteria, Order: Rhizobiales, Family: Methylobacteriaceae, Genus:
atacgaagggggctagcgttgctcggaatcactgggcgtaaagggcgcgtaggcggccatttaagtcgggggtgaaagcctgtggctcaaccacagaattgccttcgatactggatggcttgagttcggtagaggttggtggaactgcgagtgtagaggtgaaattcgtagatattcgcaagaacaccggtggcgaaggcggccaactggaccgacactgacgctgaggcgcgaaagcgtggggagcaaacagg

SEQ ID NO: 696 - DNA, 251 bp, Unknown
  Kingdom: Bacteria, Phylum: Proteobacteria, Class: Alphaproteobacteria, Order: Rhizobiales, Family: Methylobacteriaceae, Genus:
tacgaagggggctagcgttgctcggaatcactgggcgtaaagggcgcgtaggcggccattcaagtcgggggtgaaagcctgtggctcaaccacagaattgccttcgatactgtttggcttgagtatggcagaggttagtggaactgcgagtgtagaggtgaaattcgtagatattcgcaagaacaccagtggcgaaggcggctaactgggccaactgacgctgaggcgcgaaagcgtggggagcaaacagg

SEQ ID NO: 697 - DNA, 254 bp, Unknown
  Kingdom: Bacteria, Phylum: Proteobacteria, Class: Alphaproteobacteria, Order: Rhizobiales, Family: Methylobacteriaceae, Genus:
atacgaagggggctagcgttgctcggaatcactgggcgtaaagggcgcgtaggcggccattcaagtcgggggtgaaagcctgtggctcaaccacagaattgccttcgatactgtttggcttgagtatggcagaggttagtggaactgcgagtgtagaggtgaaattcgtagatattcgcaagaacaccagtggcgaaggcggctgactgggccattactgacgctgaggcgcgaaagcgtggggagcaaacagg

SEQ ID NO: 698 - DNA, 254 bp, Unknown
  Kingdom: Bacteria, Phylum: Proteobacteria, Class: Alphaproteobacteria, Order: Rhizobiales, Family: Methylobacteriaceae, Genus:
atacgaagggggctagcgttgctcggaatcactgggcgtaaagggcgcgtaggcggccattcaagtcgggggtgaaagcctgtggctcaaccacagaattgccttcgatactgtttggcttgagtatggtagaggtcggtggaactgcgagtgtagaggtgaaattcgtagatattcgcaagaacaccagtggcgaaggcggccgactggaccattactgacgctgaggcgcgaaagcgtggggagcaaacagg

SEQ ID NO: 699 - DNA, 254 bp, Unknown
  Kingdom: Bacteria, Phylum: Proteobacteria, Class: Alphaproteobacteria, Order: Rhizobiales, Family: Methylobacteriaceae, Genus:
atacgaagggggctagcgttgctcggaatcactgggcgtaaagggcgcgtaggcggccattcaagtcgggggtgaaagcctgtggctcaaccacagaattgccttcgatactgtttggcttgagtttggtagaggttggtggaactgcgagtgtagaggtgaaattcgtagatattcgcaagaacaccagtggcgaaggcggccaactggaccaacactgacgctgaggcgcgaaagcgtggggagcaaacagg

SEQ ID NO: 700 - DNA, 254 bp, Unknown
  Kingdom: Bacteria, Phylum: Proteobacteria, Class: Alphaproteobacteria, Order: Rhizobiales, Family: Methylobacteriaceae, Genus:
atacgaagggggctagcgttgctcggaatcactgggcgtaaagggcgcgtaggcggccattcaagtcgggggtgaaagcctgtggctcaaccacagaattgccttcgatactgtttggcttgagaccggaagaggtaagtggaactgcgagtgtagaggtgaaattcgtagatattcgcaagaacaccagtggcgaaggcggcttactggtccggttctgacgctgaggcgcgaaagcgtggggagcaaacagg

SEQ ID NO: 701 - DNA, 254 bp, Unknown
  Kingdom: Bacteria, Phylum: Proteobacteria, Class: Alphaproteobacteria, Order: Rhizobiales, Family: Methylobacteriaceae, Genus:
atacgaagggggctagcgttgctcggaatcactgggcgtaaagggcgcgtaggcggccattcaagtcgggggtgaaagcctgtggctcaaccacagaattgccttcgatactgtttggcttgagtatggcagaggtcagtggaactgcgagtgtagaggtgaaattcgtagatattcgcaagaacaccagtggcgaaggcggctgactgggccattactgacgctgaggcgcgaaagcgtggggagcaaacagg

SEQ ID NO: 702 - DNA, 254 bp, Unknown
  Kingdom: Bacteria, Phylum: Proteobacteria, Class: Alphaproteobacteria, Order: Rhizobiales, Family: Methylobacteriaceae, Genus:
atacgaagggggctagcgttgctcggaatcactgggcgtaaagggcgcgtaggcggccttgtaagttgggggtgaaagcccgtggctcaaccacggaattgccttcgatactgcttggcttgagtgtggtagaggttggtggaactgcgagtgtagaggtgaaattcgtagatattcgcaagaacaccggtggcgaaggcggccaactggaccatcactgacgctgaggcgcgaaagcgtggggagcaaacagg

SEQ ID NO: 703 - DNA, 254 bp, Unknown
  Kingdom: Bacteria, Phylum: Proteobacteria, Class: Alphaproteobacteria, Order: Rhizobiales, Family: Methylobacteriaceae, Genus:
atacgaagggggctagcgttgctcggaatcactgggcgtaaagggcgcgtaggcggccattcaagtcgggggtgaaagcctgtggctcaaccacagaattgccttcgatactgtttggcttgagtatggtagaggttggtggaactgcgagtgtagaggtgaaattcgtagatattcgcaagaacaccggtggcgaaggcggccaactggaccattactgacgctgaggcgcgaaagcgtggggagcaaacagg

SEQ ID NO: 704 - DNA, 254 bp, Unknown
  Kingdom: Bacteria, Phylum: Proteobacteria, Class: Alphaproteobacteria, Order: Rhizobiales, Family: Methylobacteriaceae, Genus:
atacgaagggggctagcgttgctcggaatcactgggcgtaaagggcgcgtaggcggccattcaagtcgggggtgaaagcctgtggctcaaccacagaattgccttcgatactgtttggcttgagtatggtagaggttggtggaactgcgagtgtagaggtgaaattcgtagatattcgcaagaacaccagtggcgaaggcggccaactggaccattactgacgctgaggcgcgaaagcgtggggagcaaacagg

SEQ ID NO: 705 - DNA, 254 bp, Unknown
  Kingdom: Bacteria, Phylum: Proteobacteria, Class: Alphaproteobacteria, Order: Rhizobiales, Family: Methylobacteriaceae, Genus:
atacgaagggggctagcgttgctcggaatcactgggcgtaaagggcgcgtaggcggcgttttaagtcgggggtgaaagcctgtggctcaaccacagaatggccttcgatactgggacgcttgagtatggtagaggttggtggaactgcgagtgtagaggtgaaattcgtagatattcgcaagaacaccggtggcgaaggcggccaactggaccatcactgacgctgaggcgcgaaagcgtggggagcaaacagg

SEQ ID NO: 706 - DNA, 254 bp, Unknown
  Kingdom: Bacteria, Phylum: Proteobacteria, Class: Alphaproteobacteria, Order: Rhizobiales, Family: Methylobacteriaceae, Genus:
atacgaagggggctagcgttgctcggaatcactgggcgtaaagggcgcgtaggcggccattcaagtcgggggtgaaagcctgtggctcaaccacagaattgccttcgatactgtttggcttgagtttggtagaggttggtggaactgcgagtgtagaggtgaaattcgtagatattcgcaagaacaccagtggcgaaggcggccaactggaccaatactgacgctgaggcgcgaaagcgtggggagcaaacagg

SEQ ID NO: 707 - DNA, 253 bp, Unknown
  Kingdom: Bacteria, Phylum: Proteobacteria, Class: Alphaproteobacteria, Order: Rhizobiales, Family: Methylobacteriaceae, Genus:
atacgaagggggctagcgttgttcggaatcactgggcgtaaagggcgcgtaggcggccgatcaagtcgggggtgaaagcctgtggctcaaccacagaattgccttcgatactgtttggcttgagaccggaagaggttagtgaactgcgagtgtagaggtgaaattcgtagatattcgcaagaacaccagtggcgaaggcggctgactggtccggttctgacgctgaggcgcgaaagcgtggggagcaaacagg

SEQ ID NO: 708 - DNA, 254 bp, Unknown
  Kingdom: Bacteria, Phylum: Proteobacteria, Class: Alphaproteobacteria, Order: Rhizobiales, Family: Methylobacteriaceae, Genus:
atacgaagggggctagcgttgctcggaatcactgggcgtaaagggcgcgtaggcggcgttttaagttgggggtgaaagcctgtggctcaaccacagaattgccttcgatactgggacgcttgagtgtggtagaggttggtggaactgcgagtgtagaggtgaaattcgtagatattcgcaagaacaccggtggcgaaggcggccaactggaccatcactgacgctgaggcgcgaaagcgtggggagcaaacagg

SEQ ID NO: 709 - DNA, 251 bp, Unknown
  Kingdom: Bacteria, Phylum: Proteobacteria, Class: Alphaproteobacteria, Order: Rhizobiales, Family: Methylocystaceae, Genus:
tacgaagggggctagcgttgttcggaatcactgggcgtaaagggtgcgcaggcgggttcataagtcaggggtgaaatcccgaggctcaacctcggaactgcctttgatactgtggatcttgagtccggaagaggtgagtggaactgcgagtgtagaggtgaaattcgtagatattcgcaagaacaccggtggcgaaggcggctcactggtccgactgacgctgaggcacgacagcgtggggagcaaacagg

SEQ ID NO: 710 - DNA, 251 bp, Unknown
  Kingdom: Bacteria, Phylum: Proteobacteria, Class: Alphaproteobacteria, Order: Rhizobiales, Family: Methylocystaceae, Genus:
tacgaagggggctagcgttgttcggaatcactgggcgtaaagggtgcgtaggcgggatcttaagtcaggggtgaaatcccgaggctcaacctcggaactgcctttgatactggggtccttgagtccggaagaggtgagtggaactgcgagtgtagaggtgaaattcgtagatattcgcaagaacaccggtggcgaaggcggctcactggtccgactgacgctgaggcacgacagcgtggggagcaaacagg

SEQ ID NO: 711 - DNA, 254 bp, Unknown
  Kingdom: Bacteria, Phylum: Proteobacteria, Class: Alphaproteobacteria, Order: Rhizobiales, Family: Phyllobacteriaceae, Genus:
atacgaagggggctagcgttgttcggatttactgggcgtaaagcgcacgtaggcggactattaagtcaggggtgaaatcccggggctcaaccccggaactgcctttgatactggtagtcttgagttcgagagaggtgagtggaattccgagtgtagaggtgaaattcgtagatattcggaggaacaccagtggcgaaggcggctcactggctcgatactgacgctgaggtgcgaaagcgtggggagcaaacagg

SEQ ID NO: 712 - DNA, 254 bp, Unknown
  Kingdom: Bacteria, Phylum: Proteobacteria, Class: Alphaproteobacteria, Order: Rhizobiales, Family: Phyllobacteriaceae, Genus:
atacgaagggggctagcgttgttcggaattactgggcgtaaagcgcacgtaggcggatatttaagtcaggggtgaaatcccggggctcaaccccggaactgcctctgatactgggtatctcgagtccgagagaggtgagtggaattccgagtgtagaggtgaaattcgtagatattcggaggaacaccagtggcgaaggcggctcactggctcggtactgacgctgaggtgcgaaagcgtggggagcaaacagg

SEQ ID NO: 713 - DNA, 254 bp, Unknown
  Kingdom: Bacteria, Phylum: Proteobacteria, Class: Alphaproteobacteria, Order: Rhizobiales, Family: Phyllobacteriaceae, Genus:
atacgaagggggctagcgttgttcggaattactgggcgtaaagcgcacgtaggcggatacttaagtcaggggtgaaatcccggggctcaaccccggaactgcctttgatactgggtatctcgagtccggaagaggtgagtggaattccgagtgtagaggtgaaattcgtagatattcggaggaacaccagtggcgaaggcggctcactggtccggtactgacgctgaggtgcgaaagcgtggggagcaaacagg

SEQ ID NO: 714 - DNA, 254 bp, Unknown
  Kingdom: Bacteria, Phylum: Proteobacteria, Class: Alphaproteobacteria, Order: Rhizobiales, Family: Phyllobacteriaceae, Genus:
atacgaagggggctagcgttgttcggaattactgggcgtaaagcgcacgtaggcggatatttaagtcaggggtgaaatcccggggctcaaccccggaactgcctttgatactgggtatctcgagtccgagagaggtgagtggaattccgagtgtagaggtgaaattcgtagatattcggaggaacaccagtggcgaaggcggctcactggctcggtactgacgctgaggtgcgaaagcgtggggagcaaacagg

SEQ ID NO: 715 - DNA, 254 bp, Unknown
  Kingdom: Bacteria, Phylum: Proteobacteria, Class: Alphaproteobacteria, Order: Rhizobiales, Family: Phyllobacteriaceae, Genus:
atacgaagggggctagcgttgttcggaattactgggcgtaaagcgcacgtaggcggattgttaagttaggggtgaaatcccggggctcaaccccggaactgcctttaatactggcaatctcgagtccgagagaggtgagtggaattccgagtgtagaggtgaaattcgtagatattcggaggaacaccagtggcgaaggcggctcactggctcggtactgacgctgaggtgcgaaagcgtggggagcaaacagg

SEQ ID NO: 716 - DNA, 254 bp, Unknown
  Kingdom: Bacteria, Phylum: Proteobacteria, Class: Alphaproteobacteria, Order: Rhizobiales, Family: Phyllobacteriaceae, Genus:
atacgaagggggctagcgttgttcggatttactgggcgtaaagcgcacgtaggcggacttttaagtcaggggtgaaatcccggggctcaaccccggaactgcctttgatactggaagtcttgagttcgagagaggtgagtggaattgcgagtgtagaggtgaaattcgtagatattcgcaggaacaccagtggcgaaggcggctcactggctcgatactgacgctgaggtgcgaaagcgtggggagcaaacagg

SEQ ID NO: 717 - DNA, 254 bp, Unknown
  Kingdom: Bacteria, Phylum: Proteobacteria, Class: Alphaproteobacteria, Order: Rhizobiales, Family: Rhizobiaceae, Genus:
atacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattgcgagtgtagaggtgaaattcgtagatattcgcaggaacaccagtggcgaaggcggcttactggtccataactgacgctgaggtgcgaaagcgtggggagcaaacagg

SEQ ID NO: 718 - DNA, 254 bp, Unknown
  Kingdom: Bacteria, Phylum: Proteobacteria, Class: Alphaproteobacteria, Order: Rhizobiales, Family: Rhizobiaceae, Genus:
atacgaagggggctagcgttgttcggaattactgggcgtaaagcgcacgtaggcggatatttaagtcaggggtgaaatcccgcagctcaactgcggaactgcctttgatactgggtatcttgagtatggaagaggtaagtggaattccgagtgtagaggtgaaattcgtagatattcggaggaacaccagtggcgaaggcggcttactggtccattactgacgctgaggtgcgaaagcgtggggagcaaacagg

SEQ ID NO: 719 - DNA, 254 bp, Unknown
  Kingdom: Bacteria, Phylum: Proteobacteria, Class: Alphaproteobacteria, Order: Rhizobiales, Family: Rhizobiaceae, Genus:
atacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattgcgagtgtagaggtgaaattcgtagatattcgcaggaacaccagtggcgaaggcggcttactggtccattactgacgctgaggtgcgaaagcgtggggagcaaacagg

SEQ ID NO: 720 - DNA, 251 bp, Unknown
  Kingdom: Bacteria, Phylum: Proteobacteria, Class: Alphaproteobacteria, Order: Rhizobiales, Family: Rhizobiaceae, Genus:
tacgaagggggctagcgttgttcggaattactgggcgtaaagcgcacgtaggcggatatttaagtcaggggtgaaatcccggggctcaaccccggaactgcctttgatactgggtatctagagtccagaagaggtgagtggaattccgagtgtagaggtgaaattcgtagatattcggaggaacaccagtggcgaaggcggctcactggtctgactgacgctgaggtgcgaaagcgtggggagcaaacagg

SEQ ID NO: 721 - DNA, 254 bp, Unknown
  Kingdom: Bacteria, Phylum: Proteobacteria, Class: Alphaproteobacteria, Order: Rhizobiales, Family: Rhizobiaceae, Genus:
atacgaagggggctagcgttgttcggaattactgggcgtaaagcgcacgtaggcggatatttaagtcaggggtgaaatcccagagctcaactctggaactgcctttgatactgggtatcttgagtatggaagaggtgagtggaattccgagtgtagaggtgaaattcgtagatattcggaggaacaccagtggcgaaggcggctcactggtccataactgacgctgaggtgcgaaagcgtggggagcaaacagg

SEQ ID NO: 722 - DNA, 254 bp, Unknown
  Kingdom: Bacteria, Phylum: Proteobacteria, Class: Alphaproteobacteria, Order: Rhizobiales, Family: Rhizobiaceae, Genus:
atacgaagggggctagcgttgttcggaattactgggcgtaaagcgcacgtaggcggatatttaagtcaggggtgaaatcccagagctcaactctggaactgcctttgatactgggtatcttgagtatggaagaggtgagtggaattccgagtgtagaggtgaaattcgtagatattcggaggaacaccagtggcgaaggcggctcactggtccattactgacgctgaggtgcgaaagcgtggggagcaaacagg

SEQ ID NO: 723 - DNA, 254 bp, Unknown
  Kingdom: Bacteria, Phylum: Proteobacteria, Class: Alphaproteobacteria, Order: Rhizobiales, Family: Rhizobiaceae, Genus:
atacgaagggggctagcgttgttcggaattactgggcgtaaagcgcacgtaggcggatatttaagtcaggggtgaaatcccagagctcaactctggaactgcctttgatactgggtatcttgagtatggaagaggttagtggaattgcgagtgtagaggtgaaattcgtagatattcgcaggaacaccagtggcgaaggcggctaactggtccataactgacgctgaggtgcgaaagcgtggggagcaaacagg

SEQ ID NO: 724 - DNA, 254 bp, Unknown
  Kingdom: Bacteria, Phylum: Proteobacteria, Class: Alphaproteobacteria, Order: Rhizobiales, Family: Rhizobiaceae, Genus:
atacgaagggggctagcgttgttcggaattactgggcgtaaagcgcacgtaggcggacatttaagtcaggggtgaaatcccagagctcaactctggaactgcctttgatactgggtgtctagagtatggaagaggtgagtggaattccgagtgtagaggtgaaattcgtagatattcggaggaacaccagtggcgaaggcggctcactggtccattactgacgctgaggtgcgaaagcgtggggagcaaacagg

SEQ ID NO: 725 - DNA, 254 bp, Unknown
  Kingdom: Bacteria, Phylum: Proteobacteria, Class: Alphaproteobacteria, Order: Rhizobiales, Family: Rhizobiaceae, Genus:
atacgaagggggctagcgttgttcggaattactgggcgtaaagcgcacgtaggcggatatttaagtcaggggtgaaatcccggagctcaactccggaactgcctttgatactgggtatcttgagtatggaagaggtaagtggaattgcgagtgtagaggtgaaattcgtagatattcgcaggaacaccagtggcgaaggcggcttactggtccattactgacgctgaggtgcgaaagcgtggggagcaaacagg

SEQ ID NO: 726 - DNA, 251 bp, Unknown
  Kingdom: Bacteria, Phylum: Proteobacteria, Class: Alphaproteobacteria, Order: Rhizobiales, Family: Rhizobiaceae, Genus:
tacgaagggggctagcgttgttcggatttactgggcgtaaagcgcacgtaggcggacatttaagtcaggggtgaaatcccagagctcaactctggaactgcctttgatactgggtgtctggagtatggaagaggtgagtggaattccgagtgtagaggtgaaattcgtagatattcggaggaacaccagtggcgaaggcggctcactggtccaactgacgctgaggtgcgaaagcgtggggagcaaacagg

SEQ ID NO: 727 - DNA, 254 bp, Unknown
  Kingdom: Bacteria, Phylum: Proteobacteria, Class: Alphaproteobacteria, Order: Rhizobiales, Family: Rhizobiaceae, Genus:
atacgaagggggctagcgttgttcggaattactgggcgtaaagcgcacgtaggcggacttttaagtcaggggtgaaatcccggggctcaacctcggaactgcctttgatactggaagtcttgagtatggaagaggttagtggaattgcgagtgtagaggtgaaattcgtagatattcgcaggaacaccagtggcgaaggcggctaactggtccataactgacgctgaggtgcgaaagcgtggggagcaaacagg

SEQ ID NO: 728 - DNA, 254 bp, Unknown
  Kingdom: Bacteria, Phylum: Proteobacteria, Class: Alphaproteobacteria, Order: Rhizobiales, Family: Rhizobiaceae, Genus:
atacgaagggggctagcgttgttcggaattactgggcgtaaagcgcacgtaggcggatatttaagtcaggggtgaaatcccagagctcaactctggaactgcctttgatactgggtatctggagtatggaagaggtgagtggaattccgagtgtagaggtgaaattcgtagatattcggaggaacaccagtggcgaaggcggctcactggtccattactgacgctgaggtgcgaaagcgtggggagcaaacagg

SEQ ID NO: 729 - DNA, 254 bp, Unknown
  Kingdom: Bacteria, Phylum: Proteobacteria, Class: Alphaproteobacteria, Order: Rhizobiales, Family: Rhizobiaceae, Genus:
atacgaagggggctagcgttgttcggaattactgggcgtaaagcgcacgtaggcggatatttaagtcaggggtgaaatcccagagctcaactctggaactgcctttgatactgggtatcttgagtatggaagaggtaagtggaattccgagtgtagaggtgaaattcgtagatattcggaggaacaccagtggcgaaggcggcttactggtccattactgacgctgaggtgcgaaagcgtggggagcaaacagg

SEQ ID NO: 730 - DNA, 254 bp, Unknown
  Kingdom: Bacteria, Phylum: Proteobacteria, Class: Alphaproteobacteria, Order: Rhizobiales, Family: Rhizobiaceae, Genus:
atacgaagggggctagcgttgttcggaattactgggcgtaaagcgcacgtaggcggatatttaagtcaggggtgaaatcccgcagctcaactgcggaactgcctttgatactgggtatcttgagtatggaagaggttagtggaattgcgagtgtagaggtgaaattcgtagatattcgcaggaacaccagtggcgaaggcggctaactggtccataactgacgctgaggtgcgaaagcgtggggagcaaacagg

SEQ ID NO: 731 - DNA, 254 bp, Unknown
  Kingdom: Bacteria, Phylum: Proteobacteria, Class: Alphaproteobacteria, Order: Rhizobiales, Family: Rhizobiaceae, Genus:
atacgaagggggctagcgttgttcggaattactgggcgtaaagcgcacgtaggcggatatttaagtcaggggtgaaatcccagagctcaactctggaactgcctttgatactgggtatctagagtatggaagaggtgagtggaattccgagtgtagaggtgaaattcgtagatattcggaggaacaccagtggcgaaggcggctcactggtccattactgacgctgaggtgcgaaagcgtggggagcaaacagg

SEQ ID NO: 732 - DNA, 251 bp, Unknown
  Kingdom: Bacteria, Phylum: Proteobacteria, Class: Alphaproteobacteria, Order: Rhizobiales, Family: Rhizobiaceae, Genus:
  misc_feature (246)..(246): n is a, c, g, or t
tacgaagggggctagcgttgttcggaattactgggcgtaaagcgcacgtaggcggataattaagtcaggggtgaaatcccggggctcaaccccggaactgcctttgatactggttatcttgagttcggaagaggtgagtggaattgcgagtgtagaggtgaaattcgtagatattcgcaggaacaccagtggcgaaggcggctcactggtccgactgacgctgaggtgcgaaagcgtggggagcanacagg

SEQ ID NO: 733 - DNA, 254 bp, Unknown
  Kingdom: Bacteria, Phylum: Proteobacteria, Class: Alphaproteobacteria, Order: Rhizobiales, Family: Rhizobiaceae, Genus:
atacgaagggggctagcgttgttcggaattactgggcgtaaagcgcacgtaggcggatatttaagtcaggggtgaaatcccggggctcaacctcggaactgcctttgatactgggtatcttgagtatggaagaggtaagtggaattgcgagtgtagaggtgaaattcgtagatattcgcaggaacaccagtggcgaaggcggcttactggtccattactgacgctgaggtgcgaaagcgtggggagcaaacagg

SEQ ID NO: 734 - DNA, 254 bp, Unknown
  Kingdom: Bacteria, Phylum: Proteobacteria, Class: Alphaproteobacteria, Order: Rhizobiales, Family: Rhizobiaceae, Genus:
atacgaagggggctagcgttgttcggatttactgggcgtaaagcgcacgtaggcggatcgatcagtcaggggtgaaatcccagagctcaactctggaactgcctttgatactgtcgatctggagtatggaagaggtgagtggaattccgagtgtagaggtgaaattcgtagatattcggaggaacaccagtggcgaaggcggctcactggtccattactgacgctgaggtgcgaaagcgtggggagcaaacagg

SEQ ID NO: 735 - DNA, 254 bp, Unknown
  Kingdom: Bacteria, Phylum: Proteobacteria, Class: Alphaproteobacteria, Order: Rhizobiales, Family: Rhizobiaceae, Genus:
atacgaagggggctagcgttgttcggaattactgggcgtaaagcgcacgtaggcggatcgatcagtcaggggtgaaatcccagagctcaactctggaactgcctttgatactgtcgatctagagtatggaagaggtgagtggaattccgagtgtagaggtgaaattcgtagatattcggaggaacaccagtggcgaaggcggctcactggtccattactgacgctgaggtgcgaaagcgtggggagcaaacagg

SEQ ID NO: 736 - DNA, 254 bp, Unknown
  Kingdom: Bacteria, Phylum: Proteobacteria, Class: Alphaproteobacteria, Order: Rhizobiales, Family: Rhizobiaceae, Genus:
atacgaagggggctagcgttgttcggaattactgggcgtaaagcgcacgtaggcggatatttaagtcaggggtgaaatcccagagctcaactctggaactgcctttgatactgggtatctcgagtatggaagaggtgagtggaattccgagtgtagaggtgaaattcgtagatattcggaggaacaccagtggcgaaggcggctcactggtccattactgacgctgaggtgcgaaagcgtggggagcaaacagg

SEQ ID NO: 737 - DNA, 251 bp, Unknown
  Kingdom: Bacteria, Phylum: Proteobacteria, Class: Alphaproteobacteria, Order: Rhizobiales, Family: Rhizobiaceae, Genus:
tacgaagggggctagcgttgttcggaattactgggcgtaaagcgcacgtaggcggatatttaagtcaggggtgaaatcccagagctcaactctggaactgcctttgatactgggtatcttgagtatggaagaggtgagtggaattccgagtgtagaggtgaaattcgtagatattcggaggaacaccagtggcgaaggcggctcactggtccaactgacgctgaggtgcgaaagcgtggggagcaaacagg

SEQ ID NO: 738 - DNA, 254 bp, Unknown
  Kingdom: Bacteria, Phylum: Proteobacteria, Class: Alphaproteobacteria, Order: Rhizobiales, Family: Rhizobiaceae, Genus:
atacgaagggggctagcgttgttcggaattactgggcgtaaagcgcacgtaggcggatcgatcagtcaggggtgaaatcccagagctcaactctggaactgcctttgatactgtcggtctagagtatggaagaggtgagtggaattccgagtgtagaggtgaaattcgtagatattcggaggaacaccagtggcgaaggcggctcactggtccattactgacgctgaggtgcgaaagcgtggggagcaaacagg

SEQ ID NO: 739 - DNA, 254 bp, Unknown
  Kingdom: Bacteria, Phylum: Proteobacteria, Class: Alphaproteobacteria, Order: Rhizobiales, Family: Rhizobiaceae, Genus:
atacgaagggggctagcgttgttcggaattactgggcgtaaagcgcacgtaggcggacatttaagtcaggggtgaaatcccagagctcaactctggaactgcctttgatactgggtgtcttgagtatggaagaggtgagtggaattccgagtgtagaggtgaaattcgtagatattcggaggaacaccagtggcgaaggcggctcactggtccattactgacgctgaggtgcgaaagcgtggggagcaaacagg

SEQ ID NO: 740 - DNA, 254 bp, Unknown
  Kingdom: Bacteria, Phylum: Proteobacteria, Class: Alphaproteobacteria, Order: Rhizobiales, Family: Rhizobiaceae, Genus:
atacgaagggggctagcgttgttcggaattactgggcgtaaagcgcatgtaggcggatatttaagtcaggggtgaaatcccagagctcaactctggaactgcctttgatactgggtatcttgagtatggaagaggtgagtggaattccgagtgtagaggtgaaattcgtagatattcggaggaacaccagtggcgaaggcggctcactggtccattactgacgctgaggtgcgaaagcgtggggagcaaacagg

SEQ ID NO: 741 - DNA, 254 bp, Unknown
  Kingdom: Bacteria, Phylum: Proteobacteria, Class: Alphaproteobacteria, Order: Rhizobiales, Family: Rhizobiales_Incertae_Sedis, Genus:
atacgaagggggctagcgttgttcggaattactgggcgtaaagcgcgcgcaggcggtcttccaagtcagtggtgaaagcccggagctcaactccggaactgccattgaaactgtaagacttgaggatgagagaggtgagtggaattcccagtgtagaggtgaaattcgtagatattgggaagaacaccggtggcgaaggcggctcactggctcattactgacgctcaggcgcgacagcgtggggatcaaacagg

SEQ ID NO: 742 - DNA, 254 bp, Unknown
  Kingdom: Bacteria, Phylum: Proteobacteria, Class: Alphaproteobacteria, Order: Rhizobiales, Family: Rhizobiales_Incertae_Sedis, Genus:
atacgaagggggctagcgttgttcggaattactgggcgtaaagcgcgcgcaggcggtcttccaagtcagtggtgaaagcccggagctcaactccggaactgccattgaaactgttagacttgaggacgagagaggtgagtggaattcccagtgtagaggtgaaattcgtagatattgggaagaacaccggtggcgaaggcggctcactggctcgtatctgacgctcaggcgcgatagcgtggggatcaaacagg

SEQ ID NO: 743 - DNA, 254 bp, Unknown
  Kingdom: Bacteria, Phylum: Proteobacteria, Class: Alphaproteobacteria, Order: Rhizobiales, Family: Rhizobiales_Incertae_Sedis, Genus:
atacgaagggggctagcgttgttcggaattactgggcgtaaagcgcgcgcaggcggctatccaagtcagtggtgaaagcccggagctcaactccggaactgccattgaaactgtttagcttgaggatgagagaggtgagtggaattcccagtgtagaggtgaaattcgtagatattgggaagaacaccggtggcgaaggcggctcactggctcattactgacgctcaggcgcgatagcgtggggatcaaacagg

SEQ ID NO: 744 - DNA, 254 bp, Unknown
  Kingdom: Bacteria, Phylum: Proteobacteria, Class: Alphaproteobacteria, Order: Rhizobiales, Family: Rhizobiales_Incertae_Sedis, Genus:
atacgaagggggctagcgttgttcggaattactgggcgtaaagcgcgcgcaggcggctatccaagtcagtggtgaaagcccggagctcaactccggaactgccattgaaactgtttagcttgaggacgagagaggtgagtggaattcccagtgtagaggtgaaattcgtagatattgggaagaacaccggtggcgaaggcggctcactggctcgtatctgacgctcaggcgcgacagcgtggggatcaaacagg

SEQ ID NO: 745 - DNA, 254 bp, Unknown
  Kingdom: Bacteria, Phylum: Proteobacteria, Class: Alphaproteobacteria, Order: Rhizobiales, Family: Rhizobiales_Incertae_Sedis, Genus:
atacgaagggggctagcgttgttcggaattactgggcgtaaagggcgcgtaggcggactgttaagtcaggggtgaaatcccggggctcaaccccggaactgcctttgatactggcggtcttgagttcgggagaggtgagtggaattccgagtgtagaggtgaaattcgtagatattcggaggaacaccagtggcgaaggcggctcactggcccgatactgacgctgaggcgcgaaagcgtggggagcaaacagg

SEQ ID NO: 746 - DNA, 254 bp, Unknown
  Kingdom: Bacteria, Phylum: Proteobacteria, Class: Alphaproteobacteria, Order: Rhizobiales, Family: Rhizobiales_Incertae_Sedis, Genus:
atacgaagggggctagcgttgttcggaattactgggcgtaaagcgcacgtaggcgggttgttaagtcaggggtgaaatcctggagctcaactccagaactgcctttgatactggcaacctagagactggaagaggttagtggaattcccagtgtagaggtgaaattcgtagatattgggaagaacaccagtggcgaaggcggctaactggtccagcactgacgctgaggtgcgaaagcgtggggagcaaacagg

SEQ ID NO: 747 - DNA, 254 bp, Unknown
  Kingdom: Bacteria, Phylum: Proteobacteria, Class: Alphaproteobacteria, Order: Rhizobiales, Family: Rhizobiales_Incertae_Sedis, Genus:
atacgaagggggctagcgttgttcggaattactgggcgtaaagcgcgcgcaggcggtcttccaagtcagtggtgaaagcccggagctcaactccggaactgccattgaaactgtaagacttgaggatgagagaggtgagtggaattcccagtgtagaggtgaaattcgtagatattgggaagaacaccggtggcgaaggcggctcactggctcatatctgacgctcaggcgcgacagcgtggggatcaaacagg

SEQ ID NO: 748 - DNA, 254 bp, Unknown
  Kingdom: Bacteria, Phylum: Proteobacteria, Class: Alphaproteobacteria, Order: Rhizobiales, Family: Xanthobacteraceae, Genus:
atacgaagggggctagcgttgctcggaattactgggcgtaaagcgcacgtaggcggctttctaagtcgggggtgaaatcctggagctcaactccagaactgccttcgatactggagagcttgagtccgggagaggtgagtggaactgcgagtgtagaggtgaaattcgtagatattcgcaagaacaccagtggcgaaggcggctcactggcccggtactgacgctgaggtgcgaaagcgtggggagcaaacagg

SEQ ID NO: 749 - DNA, 254 bp, Unknown
  Kingdom: Bacteria, Phylum: Proteobacteria, Class: Alphaproteobacteria, Order: Rhizobiales, Family: Xanthobacteraceae, Genus:
atacgaagggggctagcgttgctcggaattactgggcgtaaagcgcacgtaggcggaccgataagtcgggggtgaaatcctggagctcaactccagaactgccttcgaaactgccggtcttgagttcgggagaggtgagtggaactgcgagtgtagaggtgaaattcgtagatattcgcaagaacaccagtggcgaaggcggctcactggcccgatactgacgctgaggtgcgaaagcgtggggagcaaacagg

SEQ ID NO: 750 - DNA, 254 bp, Unknown
  Kingdom: Bacteria, Phylum: Proteobacteria, Class: Alphaproteobacteria, Order: Rhizobiales, Family: Xanthobacteraceae, Genus:
atacgaagggggctagcgttgctcggaatcactgggcgtaaagcgcacgtaggcggatctttaagtcaggggtgaaatcctggagctcaactccagaactgcctttgatactgaagatcttgagtccgggagaggtgagtggaactgcgagtgtagaggtgaaattcgtagatattcgcaagaacaccagtggcgaaggcggctcactggcccggtactgacgctgaggtgcgaaagcgtggggagcaaacagg

SEQ ID NO: 751 - DNA, 254 bp, Unknown
  Kingdom: Bacteria, Phylum: Proteobacteria, Class: Alphaproteobacteria, Order: Rhizobiales, Family: Xanthobacteraceae, Genus:
atacgaagggggctagcgttgctcggaattactgggcgtaaagcgcacgtaggcggctctttaagtcgggggtgaaatcctggagctcaactccagaactgccttcgatactgtagagcttgagttcgggagaggtgagtggaactgcgagtgtagaggtgaaattcgtagatattcgcaagaacaccagtggcgaaggcggctcactggcccgatactgacgctgaggtgcgaaagcgtggggagcaaacagg

SEQ ID NO: 752 - DNA, 253 bp, Unknown
  Kingdom: Bacteria, Phylum: Proteobacteria, Class: Alphaproteobacteria, Order: Rhizobiales, Family: Xanthobacteraceae, Genus:
atacgaagggggctagcgttgttcggaatcactgggcgtaaagcgcacgtaggcggattgttaagtcgggggtgaaatcctgaggctcaacctcagaactgccttcgatactggcgatcttgagtccggaagaggttggtggaacagctagtgtagaggtgaaattcgtagatattagctagaacaccagtggcgaaggcggccaactggtccggactgacgctgaggtgcgaaagcgtggggagcaaacagg

SEQ ID NO: 753 - DNA, 254 bp, Unknown
  Kingdom: Bacteria, Phylum: Proteobacteria, Class: Alphaproteobacteria, Order: Rhizobiales, Family: Xanthobacteraceae, Genus:
atacgaagggggctagcgttgctcggaatcactgggcgtaaagcgcacgtaggcggactcttaagtcaggggtgaaatcctggagctcaactccagaactgcctttgatactgggagccttgagttcgggagaggtgagtggaactgcgagtgtagaggtgaaattcgtagatattcgcaagaacaccagtggcgaaggcggctcactggcccgatactgacgctgaggtgcgaaagcgtggggagcaaacagg

SEQ ID NO: 754 - DNA, 254 bp, Unknown
  Kingdom: Bacteria, Phylum: Proteobacteria, Class: Alphaproteobacteria, Order: Rhizobiales, Family: Xanthobacteraceae, Genus:
atacgaagggggctagcgttgctcggaattactgggcgtaaagcgcacgtaggcggctttctaagtcgggggtgaaatcctggagctcaactccagaactgccttcgatactggagagctcgagtccgggagaggtgagtggaactgcgagtgtagaggtgaaattcgtagatattcgcaagaacaccagtggcgaaggcggctcactggcccggtactgacgctgaggtgcgaaagcgtggggagcaaacagg

SEQ ID NO: 755 - DNA, 255 bp, Unknown
  Kingdom: Bacteria, Phylum: Proteobacteria, Class: Alphaproteobacteria, Order: Rhizobiales, Family: Xanthobacteraceae, Genus:
atacgaagggggctagcgttgctcggaatcactgggcgtaaagcgcacgtaggcggctttctaagtcagaggtgaaatcctggagctcaactccagaactgcctttgatactggagagcttgagttcgggagaggtgagtggaactgcgagtgtagaggtgaaattcgtagatattcgcaagaacaccagtggcgaaggcggctcactggcccgatactgacgctgagggtgcgaaagcgtggggagcaaacagg

SEQ ID NO: 756 - DNA, 254 bp, Unknown
  Kingdom: Bacteria, Phylum: Proteobacteria, Class: Alphaproteobacteria, Order: Rhodobacterales, Family: Rhodobacteraceae, Genus:
atacggagggggctagcgttgttcggaattactgggcgtaaagcgcacgtaggcggaccggaaagtcagaggtgaaatcccagggctcaaccttggaactgcctttgaaactatcggtctggagttcgagagaggtgagtggaattccgagtgtagaggtgaaattcgtagatattcggaggaacaccagtggcgaaggcggctcactggctcgatactgacgctgaggtgcgaaagcgtggggagcaaacagg

SEQ ID NO: 757 - DNA, 254 bp, Unknown
  Kingdom: Bacteria, Phylum: Proteobacteria, Class: Alphaproteobacteria, Order: Rhodobacterales, Family: Rhodobacteraceae, Genus:
atacggagggggctagcgttattcggaattactgggcgtaaagcgcacgtaggcggatcagaaagtcagaggtgaaatcccagggctcaaccttggaactgcctttgaaactcctggtcttgaggtcgagagaggtgagtggaattccgagtgtagaggtgaaattcgtagatattcggaggaacaccagtggcgaaggcggctcactggctcgatactgacgctgaggtgcgaaagcgtggggagcaaacagg

SEQ ID NO: 758 - DNA, 254 bp, Unknown
  Kingdom: Bacteria, Phylum: Proteobacteria, Class: Alphaproteobacteria, Order: Rhodobacterales, Family: Rhodobacteraceae, Genus:
atacggagggggctagcgttgttcggaattactgggcgtaaagcgcacgtaggcggaccggaaagtcagaggtgaaatcccagggctcaaccttggaactgcctttgaaactcctggtcttgaggtcgagagaggtgagtggaattccgagtgtagaggtgaaattcgtagatattcggaggaacaccagtggcgaaggcggctcactggctcgatactgacgctgaggtgcgaaagcgtggggagcaaacagg

SEQ ID NO: 759 - DNA, 254 bp, Unknown
  Kingdom: Bacteria, Phylum: Proteobacteria, Class: Alphaproteobacteria, Order: Rhodospirillales, Family: Acetobacteraceae, Genus:
atacgaagggggctagcgttgctcggaattactgggcgtaaagggcgcgtaggcggtcattttagtcaggcgtgaaattcccgggcttaacctggggactgcgcttgatactgggtgacttgagggtggaagagggtcgtggaattcccagtgtagaggtgaaattcgtagatattgggaagaacaccggtggcgaaggcggcgacctggtccattactgacgctgaggcgcgacagcgtggggagcaaacagg

SEQ ID NO: 760 - DNA, 254 bp, Unknown
  Kingdom: Bacteria, Phylum: Proteobacteria, Class: Alphaproteobacteria, Order: Rhodospirillales, Family: Acetobacteraceae, Genus:
atacgaagggggctagcgttgctcggattgactgggcgtaaagggcgcgtaggcggtttgcacagtcagacgtgaaattcctgggcttaacctgggggctgcgtttgatacgtgcaggcttgagttcggaagagggtcgtggaattcccagtgtagaggtgaaattcgtagatattgggaagaacaccggtggcgaaggcggcgacctggtccgatactgacgctgaggcgcgaaagcgtggggagcaaacagg

SEQ ID NO: 761 - DNA, 254 bp, Unknown
  Kingdom: Bacteria, Phylum: Proteobacteria, Class: Alphaproteobacteria, Order: Rhodospirillales, Family: Acetobacteraceae, Genus:
atacgaagggggctagcgttgctcggaatgactgggcgtaaagggcgcgtaggcggtttgtacagtcagatgtgaaattcctgggcttaacctgggggctgcatttgatacgtgcaggcttgagtgtggaagagggtcgtggaattcccagtgtagaggtgaaattcgtagatattgggaagaacaccggtggcgaaggcggcgatctggtccataactgacgctgaggcgcgaaagcgtggggagcaaacagg

SEQ ID NO: 762 - DNA, 254 bp, Unknown
  Kingdom: Bacteria, Phylum: Proteobacteria, Class: Alphaproteobacteria, Order: Rhodospirillales, Family: Acetobacteraceae, Genus:
atacgaagggggctagcgttgctcggaatgactgggcgtaaagggcgcgtaggcggttgatgcagtcagatgtgaaatccccgggcttaacctgggaactgcatttgagacgcattgactagagttcgagagagggttgtggaattcccagtgtagaggtgaaattcgtagatattgggaagaacaccggtggcgaaggcggcaacctggctcgatactgacgctgaggcgcgaaagcgtggggagcaaacagg

SEQ ID NO: 763 - DNA, 254 bp, Unknown
  Kingdom: Bacteria, Phylum: Proteobacteria, Class: Alphaproteobacteria, Order: Rhodospirillales, Family: Acetobacteraceae, Genus:
atacgaagggggctagcgttactcggaattactgggcgtaaagggcgcgtaggcggcgctccaagttaggcgtgaaagtcctgggctcaacctgggaactgcgcttgatactggagtgcttgaggatggaagagggttgtggaattcccagtgtagaggtgaaattcgtagatattgggaagaacaccggtggcgaaggcggcaacctggtccattactgacgctgaggcgcgacagcgtggggagcaaatagg

SEQ ID NO: 764 - DNA, 254 bp, Unknown
  Kingdom: Bacteria, Phylum: Proteobacteria, Class: Alphaproteobacteria, Order: Rhodospirillales, Family: Acetobacteraceae, Genus:
atacgaagggggctagcgttactcggaattactgggcgtaaagggcgcgtaggcggcgctccaagttaggcgtgaaagtcctgggctcaacctgggaactgcgcttaagactggagtgcttgaggatggaagagggtcgtggaattcccagtgtagaggtgaaattcgtagatattgggaagaacaccggtggcgaaggcggcgacctggtccattactgacgctgaggcgcgacagcgtggggagcaaacagg

SEQ ID NO: 765 - DNA, 254 bp, Unknown
  Kingdom: Bacteria, Phylum: Proteobacteria, Class: Alphaproteobacteria, Order: Rhodospirillales, Family: Acetobacteraceae, Genus:
atacgaagggggctagcgttgctcggaatgactgggcgtaaagggcgcgtaggcggcttgtacagtcagatgtgaaattcctgggctcaacctggggactgcatttgatacgtacgggcttgagtggagaagagggttgtggaatttccagtgtagaggtgaaattcgtagatattggaaagaacaccggtggcgaaggcggcaacctggtctttaactgacgctgaggcgcgaaagcgtggggagcaaacagg

SEQ ID NO: 766 - DNA, 254 bp, Unknown
  Kingdom: Bacteria, Phylum: Proteobacteria, Class: Alphaproteobacteria, Order: Rhodospirillales, Family: Rhodospirillaceae, Genus: Dongia
atacgaagggggctagcgttgttcggaattactgggcgtaaagggcgcgtaggcggccgtttaagttaggtgtgaaagtcctgggctcaacctggggactgcacttaatactggatggcttgaattcgggagaggatagcggaattcccagtgtagaggtgaaattcgtagatattgggaagaacaccggtggcgaaggcggctatctggaccgacattgacgctgaggcgcgaaagcgtggggagcaaacagg

SEQ ID NO: 767 - DNA, 254 bp, Unknown
  Kingdom: Bacteria, Phylum: Proteobacteria, Class: Alphaproteobacteria, Order: Rhodospirillales, Family: Rhodospirillaceae, Genus:
atacgaagggggcaagcgttgttcggaattactgggcgtaaagggcgcgtaggcggcttatcaagtcaggcgtgaaattcccgggctcaacctgggggctgcgcttgatactgatgagcttgaatgcgggagaggatagtggaattcccagtgtagaggtgaaattcgtagatattgggaagaacaccggtggcgaaggcggctatctggcccgtgattgacgctgaggcgcgaaagcgtggggagcaaacagg

SEQ ID NO: 768 - DNA, 254 bp, Unknown
  Kingdom: Bacteria, Phylum: Proteobacteria, Class: Alphaproteobacteria, Order: Rhodospirillales, Family: Rhodospirillaceae, Genus:
atacgaagggggcaagcgttgttcggaattactgggcgtaaagggcgcgtaggcggcttatcaagtcaggcgtgaaattcccgggctcaacctgggggctgcgcttgatactgatgagcttgaatgcgggagaggatagtggaattcccagtgtagaggtgaaattcgtagatattgggaagaacaccggtggcgaaggcggctatctggcccgtaattgacgctgaggcgcgaaagcgtggggagcaaacagg

SEQ ID NO: 769 - DNA, 254 bp, Unknown
  Kingdom: Bacteria, Phylum: Proteobacteria, Class: Alphaproteobacteria, Order: Rhodospirillales, Family: Rhodospirillaceae, Genus:
agacggaggaggctagcgttgttcggaattactgggcgtaaagcgtgcgcaggttgtgagttcagttggatgtgaaagcccggggcttaacctcggatgtgcatccaatactggctcgctggaggttggaagaggagagtggaattcccagtgtagaggtgaaattcgtagatattgggaagaacaccagtggcgaaggcggctctctggtccatacctgacactcatgcacgaaagcgtggggagcaaacagg

SEQ ID NO: 770 - DNA, 254 bp, Unknown
  Kingdom: Bacteria, Phylum: Proteobacteria, Class: Alphaproteobacteria, Order: Rhodospirillales, Family: Rhodospirillaceae, Genus:
atacgaagggggctagcgttgttcggaattactgggcgtaaagggcgcgtaggcggtgtgtcaagtcaggcgtgaaagccccgggctcaacctgggaaccgcgcttgagactggcacgctcgagttcgggagaggatggtggaattcccagtgtagaggtgaaattcgtagatattgggaagaacaccgatggcgaaggcagccatctggaccgacactgacgctgaggcgcgaaagcgtggggagcaaacagg

SEQ ID NO: 771 - DNA, 254 bp, Unknown
  Kingdom: Bacteria, Phylum: Proteobacteria, Class: Alphaproteobacteria, Order: Rhodospirillales, Family: Rhodospirillaceae, Genus:
atacgaagggggcgagcgttgttcggaattactgggcgtaaagggcgcgtaggcggcgacccaagtcagatgtgaaagtcctgggcttaacctggggactgcatttgatactgggttgcttgaattcgggagaggatagcggaattcccagtgtagaggtgaaattcgtagatattgggaagaacaccggtggcgaaggcggctatctggaccgacattgacgctgaggcgcgaaagcgtggggagcaaacagg

SEQ ID NO: 772 - DNA, 254 bp, Unknown
  Kingdom: Bacteria, Phylum: Proteobacteria, Class: Alphaproteobacteria, Order: Rhodospirillales, Family: Rhodospirillaceae, Genus:
atacgaagggggctagcgttgttcggaattactgggcgtaaagggcgcgtaggcggtacttcaagtcaggcgtgaaagccccgggctcaacctgggaaccgcgcttgagactggagaactagagttcgggagaggatggtggaattcccagtgtagaggtgaaattcgtagatattgggaagaacaccgatggcgaaggcagccatctggaccgacactgacgctgaggcgcgaaagcgtggggagcaaacagg

SEQ ID NO: 773 - DNA, 254 bp, Unknown
  Kingdom: Bacteria, Phylum: Proteobacteria, Class: Alphaproteobacteria, Order: Rhodospirillales, Family: Rhodospirillaceae, Genus:
atacgaagggggcgagcgttgttcggaattactgggcgtaaagggcgcgtaggcggccgatcaagtcagatgtgaaagtcctgggcttaacctggggactgcatttgatactgattggcttgaattcgggagaggatagcggaattcccagtgtagaggtgaaattcgtagatattgggaagaacaccggtggcgaaggcggctatctggaccgacattgacgctgaggcgcgaaagcgtggggagcaaacagg

SEQ ID NO: 774 - DNA, 254 bp, Unknown
  Kingdom: Bacteria, Phylum: Proteobacteria, Class: Alphaproteobacteria, Order: Rhodospirillales, Family: Rhodospirillaceae, Genus:
atacgaagggggctagcgttgttcggaattactgggcgtaaagggcgcgtaggcggtccctcaagtcaggcgtgaaagccccgggctcaacctgggaaccgcgcttgagactgatgggctagagttcgggagaggatggtggaattcccagtgtagaggtgaaattcgtagatattgggaagaacaccgatggcgaaggcagccatctggaccgacactgacgctgaggcgcgaaagcgtggggagcaaacagg

SEQ ID NO: 775 - DNA, 254 bp, Unknown
  Kingdom: Bacteria, Phylum: Proteobacteria, Class: Alphaproteobacteria, Order: Rhodospirillales, Family: Rhodospirillaceae, Genus:
atacgaagggggctagcgttgttcggaattactgggcgtaaagggcgcgtaggcggcctgtttagtcagaagtgaaagccccgggctcaacctgggaatagcttttgatactggcaggcttgagttccggagaggatggtggaattcccagtgtagaggtgaaattcgtagatattgggaagaacaccggtggcgaaggcggccatctggacggacactgacgctgaggcgcgaaagcgtggggagcaaacagg

SEQ ID NO: 776 - DNA, 254 bp, Unknown
  Kingdom: Bacteria, Phylum: Proteobacteria, Class: Alphaproteobacteria, Order: Rhodospirillales, Family: Rhodospirillaceae, Genus:
atacgaagggggcgagcgttgttcggaattactgggcgtaaagggcgcgtaggcggcgactcaagtcagatgtgaaagtcctgggcttaacctggggactgcatttgatactgggttgcttgaattcgggagaggatagcggaattcccagtgtagaggtgaaattcgtagatattgggaagaacaccggtggcgaaggcggctatctggaccgacattgacgctgaggcgcgaaagcgtggggagcaaacagg

SEQ ID NO: 777 - DNA, 254 bp, Unknown
  Kingdom: Bacteria, Phylum: Proteobacteria, Class: Alphaproteobacteria, Order: Rhodospirillales, Family: Rhodospirillaceae, Genus:
atacgaagggggcgagcgttgttcggaattactgggcgtaaagggcgcgtaggcggccgatcaagtcagatgtgaaagtcctgggcttaacctggggactgcatttgatactgattggcttgaatgcaggagaggatagcggaattcccagtgtagaggtgaaattcgtagatattgggaagaacaccggtggcgaaggcggctatctggactgtgattgacgctgaggcgcgaaagcgtggggagcaaacagg

SEQ ID NO: 778 - DNA, 255 bp, Unknown
  Kingdom: Bacteria, Phylum: Proteobacteria, Class: Alphaproteobacteria, Order: Rhodospirillales, Family: Rhodospirillales_Incertae_Sedis, Genus:
agacgaagggggctagcgttgttcggaattactgggcgtaaagcgagtgtaggcggttgcccaagtcaggtgtgaaagccttgagctcaactcaagaaatgcacttggtactgggtggctagaggaccggagaggatagtggaattcccagtgtagtggtgaaatacgtagagattgggaagaacaccagtggcgaaggcggctatctggacggtttactgacgctaagactcgaaagcgtggggagcaaacagg

SEQ ID NO: 779 - DNA, 254 bp, Unknown
  Kingdom: Bacteria, Phylum: Proteobacteria, Class: Alphaproteobacteria, Order: Rickettsiales, Family: Holosporaceae, Genus:
agacggagggggctagcgttgttcggaatgactgggcgtaaagggtgcgtaggcggttttttaagtgaggcgtgaaagccctgggcttaacccaggaattgcgtttcagactggaaggcttgagtacgagagaggtaagtggaattcctagtgtagaggtgaaattcgtagatattaggaagaacaccagtggcgaaggcggcttactggctcgtaactgacgctgaggcacgaaagcgtggggagcaaacagg

SEQ ID NO: 780 - DNA, 254 bp, Unknown
  Kingdom: Bacteria, Phylum: Proteobacteria, Class: Alphaproteobacteria, Order: Sphingomonadales, Family: AKYG937, Genus:
atacggagggggctagcgttgttcggaattactgggcgtaaagcgcacgtaggcggctttgcaagttagaggtgaaagcccggggctcaaccccggaattgcctttaagactgcatcgctcgaatccaggagaggtgagtggaattccgagtgtagaggtgaaattcgtagatattcggaagaacaccagtggcgaaggcggctcactggactggtattgacgctgaggtgcgaaagcgtggggagcaaacagg

SEQ ID NO: 781 - DNA, 254 bp, Unknown
  Kingdom: Bacteria, Phylum: Proteobacteria, Class: Alphaproteobacteria, Order: Sphingomonadales, Family: Ellin6055, Genus:
atacggagggagctagcgttgttcggaattactgggcgtaaagcgcacgtaggcggctttgtaagttagaggtgaaagcccggagctcaactccggaattgcctttaagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacagg

SEQ ID NO: 782 - DNA, 254 bp, Unknown
  Kingdom: Bacteria, Phylum: Proteobacteria, Class: Alphaproteobacteria, Order: Sphingomonadales, Family: Erythrobacteraceae, Genus:
atacggagggggctagcgttgttcggatatactgggcgtaaagcgcacgtaggcggcgccgtaagtcaggggtgaaatcccggagctcaactccggaactgcccttgaaactgcagtgctagaatcctggagaggcgagtggaattccgagtgtagaggtgaaattcgtagatattcggaagaacaccagtggcgaaggcgactcgctggacaggtattgacgctgaggtgcgaaagcgtggggagcaaacagg

SEQ ID NO: 783 - DNA, 255 bp, Unknown
  Kingdom: Bacteria, Phylum: Proteobacteria, Class: Alphaproteobacteria, Order: Sphingomonadales, Family: Erythrobacteraceae, Genus:
atacggagggagctagcgttgttcggaaatactgggcgtaaagcgcacgtaggcggcgcagcaagtcagggggtgaaatcccggggctcaaccccggaactgcccttgaaactgcagtgctagaatcttggagaggcgagtggaattccgagtgtagaggtgaaattcgtagatattcggaagaacaccagtggcgaaggcgactcgctggacaagtattgacgctgaggtgcgaaagcgtggggagcaaacagg

SEQ ID NO: 784 - DNA, 254 bp, Unknown
  Kingdom: Bacteria, Phylum: Proteobacteria, Class: Alphaproteobacteria, Order: Sphingomonadales, Family: Erythrobacteraceae, Genus:
atacggagggagctagcgttgttcggaattactgggcgtaaagcgcacgtaggcggcttaccaagtcaggggtgaaatcccggggctcaaccccggaactgcccttgaaactggtaagctagaatcttggagaggcgagtggaattccgagtgtagaggtgaaattcgtagatattcggaagaacaccagtggcgaaggcgactcgctggacaagtattgacgctgaggtgcgaaagcgtggggagcaaacagg

SEQ ID NO: 785 - DNA, 254 bp, Unknown
  Kingdom: Bacteria, Phylum: Proteobacteria, Class: Alphaproteobacteria, Order: Sphingomonadales, Family: Erythrobacteraceae, Genus:
atacggagggagctagcgttgttcggaaatactgggcgtaaagcgcacgtaggcggcgcagcaagtcaggggtgaaatcccggggctcaaccccggaactgcctctgaaactgcagtgctagaatcttggagaggcgagtggaattccgagtgtagaggtgaaattcgtagatattcggaagaacaccagtggcgaaggcgactcgctggacaagtattgacgctgaggtgcgaaagcgtggggagcaaacagg

SEQ ID NO: 786 - DNA, 254 bp, Unknown
  Kingdom: Bacteria, Phylum: Proteobacteria, Class: Alphaproteobacteria, Order: Sphingomonadales, Family: Erythrobacteraceae, Genus:
atacggagggagctagcgttgttcggaattactgggcgtaaagcgcacgtaggcggcgattcaagtcagaggtgaaagcccggggctcaaccccggaactgcctttgaaactagattgctagaatcctggagaggttagtggaattccgagtgtagaggtgaaattcgtagatattcggaagaacaccagtggcgaaggcgactaactggacaggtattgacgctgaggtgcgaaagcgtggggagcaaacagg

SEQ ID NO: 787 - DNA, 254 bp, Unknown
  Kingdom: Bacteria, Phylum: Proteobacteria, Class: Alphaproteobacteria, Order: Sphingomonadales, Family: Erythrobacteraceae, Genus:
  misc_feature (61)..(61): n is a, c, g, or t
atacggagggggctagcgttgttcggaaatactgggcgtaaagcgaacgtaggcggcttgncaagtcaggggtgaaatcccagtgctcaacactggaactgcctttgaaactgccaggcttgaatcctggagaggcgagtggaattccgagtgtagaggtgaaattcgtagatattcggaagaacaccagtggcgaaggcgactcgctggacaggtattgacgctgaggttcgaaagcgtggggagcaaacagg

SEQ ID NO: 788 - DNA, 254 bp, Unknown
  Kingdom: Bacteria, Phylum: Proteobacteria, Class: Alphaproteobacteria, Order: Sphingomonadales, Family: Sphingomonadaceae, Genus: Sphingomonas
atacggagggggctagcgttattcggaattactgggcgtaaagcgcacgtaggcggctttgtaagttagaggtgaaagcccagagctcaactctggaattgcctttaagactgcatcgcttgaatcatggagaggtgagtggaattccgagtgtagaggtgaaattcgtagatattcggaagaacaccagtggcgaaggcggctcactggacatgtattgacgctgaggtgcgaaagcgtggggagcaaacagg

SEQ ID NO: 789 - DNA, 254 bp, Unknown
  Kingdom: Bacteria, Phylum: Proteobacteria, Class: Alphaproteobacteria, Order: Sphingomonadales, Family: Sphingomonadaceae, Genus:
atacggagggagctagcgttattcggaattactgggcgtaaagcgcacgtaggcggctttgtaagttagaggtgaaagcctggagctcaactccagaactgcctttaagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacagg

SEQ ID NO: 790 - DNA, 254 bp, Unknown
  Kingdom: Bacteria, Phylum: Proteobacteria, Class: Alphaproteobacteria, Order: Sphingomonadales, Family: Sphingomonadaceae, Genus:
atacggagggggctagcgttgttcggaattactgggcgtaaagcgcacgtaggcggctttgtaagttagaggtgaaagcctggagctcaactccagaattgcctttaagactgcatcgcttgaatccgggagaggtgagtggaattccgagtgtagaggtgaaattcgtagatattcggaagaacaccagtggcgaaggcggctcactggaccggcattgacgctgaggtgcgaaagcgtggggagcaaacagg

SEQ ID NO: 791 - DNA, 251 bp, Unknown
  Kingdom: Bacteria, Phylum: Proteobacteria, Class: Alphaproteobacteria, Order: Sphingomonadales, Family: Sphingomonadaceae, Genus:
tacggagggagctagcgttgttcggaattactgggcgtaaagcgcacgtaggcggctttgtaagttagaggtgaaagcccggggctcaaccccggaactgcctttgatactgcatggcttgaatccaggagaggtgagtggaattccgagtgtagaggtgaaattcgtagatattcggaagaacaccagtggcgaaggcggctcactggactgattgacgctgaggtgcgaaagcgtggggagcaaacagg

SEQ ID NO: 792 - DNA, 254 bp, Unknown
  Kingdom: Bacteria, Phylum: Proteobacteria, Class: Alphaproteobacteria, Order: Sphingomonadales, Family: Sphingomonadaceae, Genus:
atacggagggggctagcgttgttcggaattactgggcgtaaagcgcacgtaggcggctttgtaagtcaggggtgaaagcctggagctcaactccagaactgcctttgagactgcatcgcttgaatccgggagaggtgagtggaattccgagtgtagaggtgaaattcgtagatattcggaagaacaccagtggcgaaggcggctcactggaccggaattgacgctgaggtgcgaaagcgtggggagcaaacagg

SEQ ID NO: 793 - DNA, 254 bp, Unknown
  Kingdom: Bacteria, Phylum: Proteobacteria, Class: Alphaproteobacteria, Order: Sphingomonadales, Family: Sphingomonadaceae, Genus:
atacggagggagctagcgttattcggaattactgggcgtaaagcgcacgtaggcggctttgtaagttagaggtgaaagcccagagctcaactctggaattgcctttgatactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacagg

SEQ ID NO: 794 - DNA, 254 bp, Unknown
  Kingdom: Bacteria, Phylum: Proteobacteria, Class: Alphaproteobacteria, Order: Sphingomonadales, Family: Sphingomonadaceae, Genus:
atacggagggagctagcgttgttcggaattactgggcgtaaagcgcacgtaggcggctattcaagtcagaggtgaaagcccggggctcaaccccggaactgcctttgaaactagatagcttgaatccaggagaggtgagtggaattccgagtgtagaggtgaaattcgtagatattcggaagaacaccagtggcgaaggcggctcactggactggtattgacgctgaggtgcgaaagcgtggggagcaaacagg

SEQ ID NO: 795 - DNA, 254 bp, Unknown
  Kingdom: Bacteria, Phylum: Proteobacteria, Class: Alphaproteobacteria, Order: Sphingomonadales, Family: Sphingomonadaceae, Genus:
atacggagggagctagcgttgttcggaattactgggcgtaaagcgcacgtaggcggctttgtaagtcagaggtgaaagcctggagctcaactccagaactgcctttgagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacagg

SEQ ID NO: 796 - DNA, 254 bp, Unknown
  Kingdom: Bacteria, Phylum: Proteobacteria, Class: Alphaproteobacteria, Order: Sphingomonadales, Family: Sphingomonadaceae, Genus:
atacggagggagctagcgttattcggaattactgggcgtaaagcgtacgtaggcggctttgcaagttagaggtgaaagcctggagctcaactccagaactgcctttaaaactgcatcgcttgaatccaggagaggtgagtggaattccgagtgtagaggtgaaattcgtagatattcggaagaacaccagtggcgaaggcggctcactggactggtattgacgctgaggtacgaaagcgtggggagcaaacagg

SEQ ID NO: 797 - DNA, 254 bp, Unknown
  Kingdom: Bacteria, Phylum: Proteobacteria, Class: Alphaproteobacteria, Order: Sphingomonadales, Family: Sphingomonadaceae, Genus:
atacggagggggctagcgttgttcggaattactgggcgtaaagcgcacgtaggcggctttgtaagttagaggtgaaagcccagggcttaaccctggaattgcctttaagactgcatcgctagaatcgtggagaggtgagtggaattccgagtgtagaggtgaaattcgtagatattcggaagaacaccagtggcgaaggcgactcactggacacgtattgacgctgaggtgcgaaagcgtggggagcaaacagg

SEQ ID NO: 798 - DNA, 254 bp, Unknown
  Kingdom: Bacteria, Phylum: Proteobacteria, Class: Alphaproteobacteria, Order: Sphingomonadales, Family: Sphingomonadaceae, Genus:
atacggagggggctagcgttgttcggaattactgggcgtaaagcgtacgtaggcggctttgtaagttagaggtgaaagcccagagctcaactctggaattgcctttaagactgcatcgcttgaatcgtggagaggttagtggaattccgagtgtagaggtgaaattcgtagatattcggaagaacaccagtggcgaaggcgactaactggacacgtattgacgctgaggtacgaaagcgtggggagcaaacagg

SEQ ID NO: 799 - DNA, 254 bp, Unknown
  Kingdom: Bacteria, Phylum: Proteobacteria, Class: Alphaproteobacteria, Order: Sphingomonadales, Family: Sphingomonadaceae, Genus:
atacggagggagctagcgttgttcggaattactgggcgtaaagcgcgcgtaggcggttactcaagtcagaggtgaaagcccggggctcaaccccggaactgcctttgaaactaggtaactagaatcttggagaggtcagtggaattccgagtgtagaggtgaaattcgtagatattcggaagaacaccagtggcgaaggcgactgactggacaagtattgacgctgaggtgcgaaagcgtggggagcaaacagg

SEQ ID NO: 800 - DNA, 254 bp, Unknown
  Kingdom: Bacteria, Phylum: Proteobacteria, Class: Alphaproteobacteria, Order: Sphingomonadales, Family: Sphingomonadaceae, Genus:
atacggagggagctagcgttgttcggaattactgggcgtaaagcgcacgtaggcggctttgtaagttagaggtgaaagcctggagctcaactccagaattgcctttgatactgcatggcttgaatccaggagaggtgagtggaattccgagtgtagaggtgaaattcgtagatattcggaagaacaccagtggcgaaggcggctcactggactggtattgacgctgaggtgcgaaagcgtggggagcaaacagg

SEQ ID NO: 801 - DNA, 254 bp, Unknown
  Kingdom: Bacteria, Phylum: Proteobacteria, Class: Alphaproteobacteria, Order: Sphingomonadales, Family: Sphingomonadaceae, Genus:
atacggagggggctagcgttgttcggaattactgggcgtaaagcgcacgtaggcggctttgtaagtcaggggtgaaagcctggagctcaactccagaactgcctttgagactgcatcgcttgaatccgggagaggtgagtggaattccgagtgtagaggtgaaattcgtagatattcggaagaacaccagtggcgaaggcggctcactggaccggtattgacgctgaggtgcgaaagcgtggggagcaaacagg

SEQ ID NO: 802 - DNA, 254 bp, Unknown
  Kingdom: Bacteria, Phylum: Proteobacteria, Class: Alphaproteobacteria, Order: Sphingomonadales, Family: Sphingomonadaceae, Genus:
atacggagggagctagcgttgttcggaattactgggcgtaaagcgcacgtaggcggctttgtaagtcagaggtgaaagcctggagctcaactccagaactgcctttgagactgcatcgcttgaatccgggagaggtgagtggaattccgagtgtagaggtgaaattcgtagatattcggaagaacaccagtggcgaaggcggctcactggaccggtattgacgctgaagtgcgaaagcgtggggagcaaacagg

SEQ ID NO: 803 - DNA, 254 bp, Unknown
  Kingdom: Bacteria, Phylum: Proteobacteria, Class: Alphaproteobacteria, Order: Sphingomonadales, Family: Sphingomonadaceae, Genus:
atacggagggggctagcgttattcggaattactgggcgtaaagcgcacgtaggcggctttgtaagttagaggtgaaagcctggagctcaactccagaattgcctttaagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacagg

SEQ ID NO: 804 - DNA, 254 bp, Unknown
  Kingdom: Bacteria, Phylum: Proteobacteria, Class: Alphaproteobacteria, Order: Sphingomonadales, Family: Sphingomonadaceae, Genus:
atacggagggggctagcgttgttcggaattactgggcgtaaagcgcacgtaggcggctttgtaagttagaggtgaaagcctggagctcaactccagaactgcctttaagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacagg

SEQ ID NO: 805 - DNA, 254 bp, Unknown
  Kingdom: Bacteria, Phylum: Proteobacteria, Class: Alphaproteobacteria, Order: Sphingomonadales, Family: Sphingomonadaceae, Genus:
atacggagggagctagcgttgttcggaattactgggcgtaaagcgcgcgtaggcggctattcaagtcagaggtgaaagcccggggctcaaccccggaactgcctttgaaactagatagctagaatcttggagaggtcagtggaattccgagtgtagaggtgaaattcgtagatattcggaagaacaccagtggcgaaggcgactgactggacaagtattgacgctgaggtgcgaaagcgtggggagcaaacagg

SEQ ID NO: 806 - DNA, 254 bp, Unknown
  Kingdom: Bacteria, Phylum: Proteobacteria, Class: Alphaproteobacteria, Order: Sphingomonadales, Family: Sphingomonadaceae, Genus:
atacggagggagctagcgttgttcggaattactgggcgtaaagcgcgcgtaggcggctgctcaagtcagaggtgaaagcccggggctcaaccccggaactgcctttgaaactaggtagctagaatcttggagaggtcagtggaattccgagtgtagaggtgaaattcgtagatattcggaagaacaccagtggcgaaggcgactgactggacaagtattgacgctgaggtgcgaaagcgtggggagcaaacagg

SEQ ID NO: 807 - DNA, 254 bp, Unknown
  Kingdom: Bacteria, Phylum: Proteobacteria, Class: Alphaproteobacteria, Order: Sphingomonadales, Family: Sphingomonadaceae, Genus:
atacggagggggctagcgttgttcggaattactgggcgtaaagcgcacgtaggcggcgatttaagtcaggggtgaaagcccagtgctcaacactggaactgcccttgagactggattgcttgaatcacggagaggtgggtggaattccgagtgtagaggtgaaattcgtagatattcggaagaacaccagtggcgaaggcggcccactggacgtgtattgacgctgaggtgcgaaagcgtggggagcaaacagg

SEQ ID NO: 808 - DNA, 254 bp, Unknown
  Kingdom: Bacteria, Phylum: Proteobacteria, Class: Alphaproteobacteria, Order: Sphingomonadales, Family: Sphingomonadaceae, Genus:
atacggagggagctagcgttgttcggaattactgggcgtaaagcgcgcgtaggcggctattcaagtcagaggtgaaagcccggggctcaaccccggaactgcctttgaaactaggtagctagaatcttggagaggtcagtggaattccgagtgtagaggtgaaattcgtagatattcggaagaacaccagtggcgaaggcgactgactggacaagtattgacgctgaggtgcgaaagcgtggggagcaaacagg

SEQ ID NO: 809 - DNA, 254 bp, Unknown
  Kingdom: Bacteria, Phylum: Proteobacteria, Class: Alphaproteobacteria, Order: Sphingomonadales, Family: Sphingomonadaceae, Genus:
atacggagggggctagcgttgttcggaattactgggcgtaaagcgcacgtaggcggctttgtaagtcaggggtgaaagcctggagctcaactccagaactgcctttgagactgcatcgcttgaatccgggagaggtgagtggaattccgagtgtagaggtgaaattcgtagatattcggaagaacaccagtggcgaaggcggctcactggaccgggattgacgctgaggtgcgaaagcgtggggagcaaacagg

SEQ ID NO: 810 - DNA, 251 bp, Unknown
  Kingdom: Bacteria, Phylum: Proteobacteria, Class: Alphaproteobacteria, Order: Sphingomonadales, Family: Sphingomonadaceae, Genus:
tacggagggagctagcgttgttcggaattactgggcgtaaagcgcacgtaggcggctttgtaagttagaggtgaaagcctggagctcaactccagaattgcctttaagactgcatcgcttgaatccaggagaggtgagtggaattccgagtgtagaggtgaaattcgtagatattcggaagaacaccagtggcgaaggcggctcactggactgattgacgctgaggtgcgaaagcgtggggagcaaacagg

SEQ ID NO: 811 - DNA, 254 bp, Unknown
  Kingdom: Bacteria, Phylum: Proteobacteria, Class: Alphaproteobacteria, Order: Sphingomonadales, Family: Sphingomonadaceae, Genus:
atacggagggagctagcgttgttcggaattactgggcgtaaagcgcacgtaggcggcgatttaagtcagaggtgaaagcccggggctcaaccccggaactgcctttgagactggattgctagaatcttggagaggcgagtggaattccgagtgtagaggtgaaattcgtagatattcggaagaacaccagtggcgaaggcggctcgctggacaagtattgacgctgaggtgcgaaagcgtggggagcaaacagg

SEQ ID NO: 812 - DNA, 254 bp, Unknown
  Kingdom: Bacteria, Phylum: Proteobacteria, Class: Alphaproteobacteria, Order: Sphingomonadales, Family: Sphingomonadaceae, Genus:
atacggagggggctagcgttgttcggaattactgggcgtaaagcgcacgtaggcggcgatttaagtcaggggtgaaagcccagtgctcaacactggaactgcctttgagactggattgcttgaatcacggagaggtgggtggaattccgagtgtagaggtgaaattcgtagatattcggaagaacaccagtggcgaaggcggcccactggacgtgtattgacgctgaggtgcgaaagcgtggggagcaaacagg

SEQ ID NO: 813 - DNA, 254 bp, Unknown
  Kingdom: Bacteria, Phylum: Proteobacteria, Class: Alphaproteobacteria, Order: Sphingomonadales, Family: Sphingomonadaceae, Genus:
atacggagggagctagcgttgttcggaattactgggcgtaaagcgcacgtaggcggctttgtaagttagaggtgaaagcctggagctcaactccagaattgcctttaagactgcatcgcttgaatccaagagaggtgagtggaattccgagtgtagaggtgaaattcgtagatattcggaagaacaccagtggcgaaggcggctcactggcttggtattgacgctgaggtgcgaaagcgtggggagcaaacagg

SEQ ID NO: 814 - DNA, 251 bp, Unknown
  Kingdom: Bacteria, Phylum: Proteobacteria, Class: Alphaproteobacteria, Order: Sphingomonadales, Family: Sphingomonadaceae, Genus:
tacggagggggctagcgttgttcggaattactgggcgtaaagcgcacgtaggcggctttgtaagttagaggtgaaagcctggagctcaactccagaactgcctttaagactgcatcgcttgaatccaggagaggtgagtggaattccgagtgtagaggtgaaattcgtagatattcggaagaacaccagtggcgaaggcggctcactggactgattgacgctgaggtgcgaaagcgtggggagcaaacagg

SEQ ID NO: 815 - DNA, 254 bp, Unknown
  Kingdom: Bacteria, Phylum: Proteobacteria, Class: Alphaproteobacteria, Order: Sphingomonadales, Family: Sphingomonadaceae, Genus:
atacggagggagctagcgttattcggaattactgggcgtaaagcgcacgtaggcggctttgtaagtcagaggtgaaagcctggagctcaactccagaactgcctttgagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacagg

SEQ ID NO: 816 - DNA, 254 bp, Unknown
  Kingdom: Bacteria, Phylum: Proteobacteria, Class: Alphaproteobacteria, Order: Sphingomonadales, Family: Sphingomonadaceae, Genus:
atacggagggggctagcgttgttcggaattactgggcgtaaagcgcacgtaggcggctttgtaagtcaggggtgaaagcctggagctcaactccagaactgcctttgagactgcatcgcttgaatccgggagaggtaagtggaattccgagtgtagaggtgaaattcgtagatattcggaagaacaccagtggcgaaggcggcttactggaccgggattgacgctgaggtgcgaaagcgtggggagcaaacagg

SEQ ID NO: 817 - DNA, 254 bp, Unknown
  Kingdom: Bacteria, Phylum: Proteobacteria, Class: Alphaproteobacteria, Order: Sphingomonadales, Family: Sphingomonadaceae, Genus:
atacggagggagctagcgttgttcggaattactgggcgtaaagcgcgcgtaggcggttttttaagtcagaggtgaaagcccagtgctcaacactggaactgcctttgaaactggaaaacttgaatcttggagaggtcagtggaattccgagtgtagaggtgaaattcgtagatattcggaagaacaccagtggcgaaggcgactgactggacaagtattgacgctgaggtgcgaaagcgtggggagcaaacagg

SEQ ID NO: 818 - DNA, 254 bp, Unknown
  Kingdom: Bacteria, Phylum: Proteobacteria, Class: Alphaproteobacteria, Order: Sphingomonadales, Family: Sphingomonadaceae, Genus:
atacggagggggctagcgttgttcggaattactgggcgtaaagcgcacgtaggcggctttgtaagtcagaggtgaaagcctggagctcaactccagaactgcctttgagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacagg

SEQ ID NO: 819 - DNA, 251 bp, Unknown
  Kingdom: Bacteria, Phylum: Proteobacteria, Class: Alphaproteobacteria, Order: Sphingomonadales, Family: Sphingomonadaceae, Genus:
tacggagggggctagcgttgttcggaattactgggcgtaaagcgcacgtaggcggctttgtaagtcaggggtgaaagcctggagctcaactccagaactgcctttgagactgcatcgcttgaatccgggagaggtgagtggaattccgagtgtagaggtgaaattcgtagatattcggaagaacaccagtggcgaaggcggctcactggaccgattgacgctgaggtgcgaaagcgtggggagcaaacagg

SEQ ID NO: 820 - DNA, 254 bp, Unknown
  Kingdom: Bacteria, Phylum: Proteobacteria, Class: Alphaproteobacteria, Order: Sphingomonadales, Family: Sphingomonadaceae, Genus:
atacggagggggctagcgttgttcggaattactgggcgtaaagcgcacgtaggcggctttgtaagttagaggtgaaagcccggggctcaactccggaattgcctttaagactgcatcgctagaattgtggagaggtgagtggaattccgagtgtagaggtgaaattcgtagatattcggaagaacaccagtggcgaaggcgactcactggacacatattgacgctgaggtgcgaaagcgtggggagcaaacagg

SEQ ID NO: 821 - DNA, 254 bp, Unknown
  Kingdom: Bacteria, Phylum: Proteobacteria, Class: Alphaproteobacteria, Order: Sphingomonadales, Family: Sphingomonadaceae, Genus:
atacggagggggctagcgttgttcggaattactgggcgtaaagcgcacgtaggcggctttgtaagttagaggtgaaagcccggagctcaactccggaattgcctttaagactgcatcgctagaattgtggagaggtgagtggaattccgagtgtagaggtgaaattcgtagatattcggaagaacaccagtggcgaaggcgactcactggacacatattgacgctgaggtgcgaaagcgtggggagcaaacagg

SEQ ID NO: 822 - DNA, 251 bp, Unknown
  Kingdom: Bacteria, Phylum: Proteobacteria, Class: Alphaproteobacteria, Order: Sphingomonadales, Family: Sphingomonadaceae, Genus:
tacggagggagctagcgttgttcggaattactgggcgtaaagcgcacgtaggcggctttgtaagttagaggtgaaagcctggggctcaaccccagaattgcctttgatactgcatggcttgaatccaggagaggtgagtggaattccgagtgtagaggtgaaattcgtagatattcggaagaacaccagtggcgaaggcggctcactggactgattgacgctgaggtgcgaaagcgtggggagcaaacagg

SEQ ID NO: 823 - DNA, 254 bp, Unknown
  Kingdom: Bacteria, Phylum: Proteobacteria, Class: Alphaproteobacteria, Order: Sphingomonadales, Family: Sphingomonadaceae, Genus:
atacggagggggctagcgttgttcggaattactgggcgtaaagcgcacgtaggcggctttgtaagttagaggtgaaagcccggggctcaactccggaattgcctttaagactgcatcgctagaacgtcggagaggtaagtggaattccgagtgtagaggtgaaattcgtagatattcggaagaacaccagtggcgaaggcgacttactggacgactgttgacgctgaggtgcgaaagcgtggggagcaaacagg

SEQ ID NO: 824 - DNA, 254 bp, Unknown
  Kingdom: Bacteria, Phylum: Proteobacteria, Class: Alphaproteobacteria, Order: Sphingomonadales, Family: Sphingomonadaceae, Genus:
atacggagggggctagcgttgttcggaattactgggcgtaaagcgtacgtaggcggttttgtaagttagaggtgaaagcccggagctcaacttcggaattgcctttaagactgcatcacttgaacgtcggagaggtgagtggaattccgagtgtagaggtgaaattcgtagatattcggaagaacaccagtggcgaaggcggctcactggacgactgttgacgctgaggtacgaaagcgtggggagcaaacagg

SEQ ID NO: 825 - DNA, 254 bp, Unknown
  Kingdom: Bacteria, Phylum: Proteobacteria, Class: Alphaproteobacteria, Order: Sphingomonadales, Family: Sphingomonadaceae, Genus:
atacggagggggctagcgttgttcggaattactgggcgtaaagcgcacgtaggcggctttgtaagttaggggtgaaagcctggagctcaactccagaattgcctttaagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacagg

SEQ ID NO: 826 - DNA, 254 bp, Unknown
  Kingdom: Bacteria, Phylum: Proteobacteria, Class: Alphaproteobacteria, Order: Sphingomonadales, Family: Sphingomonadaceae, Genus:
atacggagggagctagcgttattcggaattactgggcgtaaagcgcacgtaggcggctttgtaagtaagaggtgaaagcccagagctcaactctggaattgccttttagactgcatcgcttgaatcatggagaggtcagtggaattccgagtgtagaggtgaaattcgtagatattcggaagaacaccagtggcgaaggcggctgactggacatgtattgacgctgaggtgcgaaagcgtggggagcaaacagg

SEQ ID NO: 827 - DNA, 254 bp, Unknown
  Kingdom: Bacteria, Phylum: Proteobacteria, Class: Alphaproteobacteria, Order: Sphingomonadales, Family: Sphingomonadaceae, Genus:
atacggagggggctagcgttgttcggaattactgggcgtaaagcgcgcgtaggcggctttgtaagttagaggtgaaagcccggagcttaactccggaactgcctttaagactgcatcgctagaattgtggagaggtgagtggaattccgagtgtagaggtgaaattcgtagatattcggaagaacaccagtggcgaaggcgactcactggacacatattgacgctgaggtgcgaaagcgtggggagcaaacagg

SEQ ID NO: 828 - DNA, 254 bp, Unknown
  Kingdom: Bacteria, Phylum: Proteobacteria, Class: Alphaproteobacteria, Order: Sphingomonadales, Family: Sphingomonadaceae, Genus:
atacggagggggctagcgttgttcggaattactgggcgtaaagcgcacgtaggcggctttgtaagttagaggtgaaagcccggagctcaactccggaattgcctttaagactgcatcgctcgaatcatggagaggtgagtggaattccgagtgtagaggtgaaattcgtagatattcggaagaacaccagtggcgaaggcgactcactggacatgtattgacgctgaggtgcgaaagcgtggggagcaaacagg

SEQ ID NO: 829 - DNA, 251 bp, Unknown
  Kingdom: Bacteria, Phylum: Proteobacteria, Class: Alphaproteobacteria, Order: Sphingomonadales, Family: Sphingomonadaceae, Genus:
tacggagggagctagcgttattcggaattactgggcgtaaagcgcacgtaggcggctttgtaagtaagaggtgaaagcccagagctcaactctggaattgccttttagactgcatcgcttgaatcatggagaggtcagtggaattccgagtgtagaggtgaaattcgtagatattcggaagaacaccagtggcgaaggcggctgactggacatattgacgctgaggtgcgaaagcgtggggagcaaacagg

SEQ ID NO: 830 - DNA, 254 bp, Unknown
  Kingdom: Bacteria, Phylum: Proteobacteria, Class: Alphaproteobacteria, Order: Sphingomonadales, Family: Sphingomonadaceae, Genus:
atacggagggagctagcgttgttcggaattactgggcgtaaagcgtacgtaggcggttattcaagtcagaggtgaaagcctggagctcaactccagaactgcctttgaaactagatagctagaatcttggagaggtgagtggaattccgagtgtagaggtgaaattcgtagatattcggaagaacaccagtggcgaaggcgactcactggacaagtattgacgctgaggtacgaaagcgtggggagcaaacagg

SEQ ID NO: 831 - DNA, 254 bp, Unknown
  Kingdom: Bacteria, Phylum: Proteobacteria, Class: Alphaproteobacteria, Order: Sphingomonadales, Family: Sphingomonadaceae, Genus:
atacggagggggctagcgttgttcggaattactgggcgtaaagcgcacgtaggcggctttgtaagttagaggtgaaagcccggggctcaactccggaattgcctttaagactgcatcgcttgaacgtcggagaggtgagtggaattccgagtgtagaggtgaaattcgtagatattcggaagaacaccagtggcgaaggcgactcactggacgactgttgacgctgaggtgcgaaagcgtggggagcaaacagg

SEQ ID NO: 832 - DNA, 254 bp, Unknown
  Kingdom: Bacteria, Phylum: Proteobacteria, Class: Alphaproteobacteria, Order: Sphingomonadales, Family: Sphingomonadaceae, Genus:
atacggagggagctagcgttgttcggaattactgggcgtaaagcgcgcgtaggcggtttctcaagtcagaggtgaaagcccggggctcaaccccggaactgcctttgaaactaggagactagaatcttggagaggtcagtggaattccgagtgtagaggtgaaattcgtagatattcggaagaacaccagtggcgaaggcgactgactggacaagtattgacgctgaggtgcgaaagcgtggggagcaaacagg

SEQ ID NO: 833 - DNA, 254 bp, Unknown
  Kingdom: Bacteria, Phylum: Proteobacteria, Class: Alphaproteobacteria, Order: Sphingomonadales, Family: Sphingomonadaceae, Genus:
atacggagggggctagcgttgttcggaattactgggcgtaaagcgcacgtaggcggctttgtaagttagaggtgaaagcccggggctcaactccggaattgcctttaagactgcatcgctagaattgtggagaggtaagtggaattccgagtgtagaggtgaaattcgtagatattcggaagaacaccagtggcgaaggcgacttactggacacatattgacgctgaggtgcgaaagcgtggggagcaaacagg

SEQ ID NO: 834 - DNA, 254 bp, Unknown
  Kingdom: Bacteria, Phylum: Proteobacteria, Class: Alphaproteobacteria, Order: Sphingomonadales, Family: Sphingomonadaceae, Genus:
atacggagggagctagcgttgttcggaattactgggcgtaaagcgcacgtaggcggctattcaagtcgggggtgaaagcccggggctcaaccccggaactgccctcgaaactaggtagctagaatcttggagaggtcagtggaattccgagtgtagaggtgaaattcgtagatattcggaagaacaccagtggcgaaggcgactgactggacaagtattgacgctgaggtgcgaaagcgtggggagcaaacagg

SEQ ID NO: 835 - DNA, 254 bp, Unknown
  Kingdom: Bacteria, Phylum: Proteobacteria, Class: Alphaproteobacteria, Order: Sphingomonadales, Family: Sphingomonadaceae, Genus:
atacggagggggctagcgttgttcggaattactgggcgtaaagcgcacgtaggcggctttgtaagttagaggtgaaagcctggagcttaactccagaactgcctttaagactgcatcgcttgaatccgggagaggtgagtggaattccgagtgtagaggtgaaattcgtagatattcggaagaacaccagtggcgaaggcggctcactggaccggtattgacgctgaggtgcgaaagcgtggggagcaaacagg

SEQ ID NO: 836 - DNA, 254 bp, Unknown
  Kingdom: Bacteria, Phylum: Proteobacteria, Class: Alphaproteobacteria, Order: Sphingomonadales, Family: Sphingomonadaceae, Genus:
atacggagggggctagcgttgttcggaattactgggcgtaaagcgcgcgtaggcggctttgtaagttagaggtgaaagcccggagctcaactccggaactgcctttaagactgcatcgctagaattgtggagaggtaagtggaattccgagtgtagaggtgaaattcgtagatattcggaagaacaccagtggcgaaggcgacttactggacacatattgacgctgaggtgcgaaagcgtggggagcaaacagg

SEQ ID NO: 837 - DNA, 254 bp, Unknown
  Kingdom: Bacteria, Phylum: Proteobacteria, Class: Alphaproteobacteria, Order: Sphingomonadales, Family: Sphingomonadaceae, Genus:
atacggagggggctagcgttgttcggaattactgggcgtaaagcgcacgtaggcggctttgtaagtcagaggtgaaagcctggagctcaactccagaactgcctttgagactgcatcgcttgaatccaggagaggtcagtggaattccgagtgtagaggtgaaattcgtagatattcggaagaacaccagtggcgaaggcggctgactggactggtattgacgctgaggtgcgaaagcgtggggagcaaacagg

SEQ ID NO: 838 - DNA, 254 bp, Unknown
  Kingdom: Bacteria, Phylum: Proteobacteria, Class: Alphaproteobacteria, Order: Sphingomonadales, Family: Sphingomonadaceae, Genus:
atacggagggagctagcgttattcggaattactgggcgtaaagcgcacgtaggcggctttgtaagtaagaggtgaaagcctggtgctcaacaccagaactgccttttagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacagg

SEQ ID NO: 839 - DNA, 254 bp, Unknown
  Kingdom: Bacteria, Phylum: Proteobacteria, Class: Alphaproteobacteria, Order: Sphingomonadales, Family: Sphingomonadaceae, Genus:
atacggagggagctagcgttgttcggaattactgggcgtaaagcgcacgtaggcggctttgtaagttagaggtgaaagcctggagctcaactccagaactgcctttaagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacagg

SEQ ID NO: 840 - DNA, 254 bp, Unknown
  Kingdom: Bacteria, Phylum: Proteobacteria, Class: Alphaproteobacteria, Order: Sphingomonadales, Family: Sphingomonadaceae, Genus:
atacggagggggctagcgttattcggaattactgggcgtaaagcgcacgtaggcggctttgtaagtcagaggtgaaagcctggagctcaactccagaactgcctttgagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacagg

SEQ ID NO: 841 - DNA, 254 bp, Unknown
  Kingdom: Bacteria, Phylum: Proteobacteria, Class: Alphaproteobacteria, Order: Sphingomonadales, Family: Sphingomonadaceae, Genus:
atacggagggagctagcgttattcggaattactgggcgtaaagcgcacgtaggcggctttgtaagttagaggtgaaagcctggagctcaactccagaattgcctttaagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacagg

SEQ ID NO: 842 - DNA, 251 bp, Unknown
  Kingdom: Bacteria, Phylum: Proteobacteria, Class: Alphaproteobacteria, Order: Sphingomonadales, Family: Sphingomonadaceae, Genus:
tacggagggagctagcgttgttcggaattactgggcgtaaagcgtacgtaggcggttattcaagtcagaggtgaaagcccggggctcaaccccggaactgcctttgaaactagataactagagtcttggagaggttagtggaattccgagtgtagaggtgaaattcgtagatattcggaagaacaccagtggcgaaggcgactaactggacaaactgacgctgaggtacgaaagcgtggggagcaaacagg

SEQ ID NO: 843 - DNA, 254 bp, Unknown
  Kingdom: Bacteria, Phylum: Proteobacteria, Class: Alphaproteobacteria, Order: Sphingomonadales, Family: Sphingomonadaceae, Genus:
atacggagggagctagcgttgttcggaattactgggcgtaaagcgcacgtaggcggctttgtaagttagaggtgaaagcctggagctcaactccagaactgcctttaaaactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacagg

SEQ ID NO: 844 - DNA, 254 bp, Unknown
  Kingdom: Bacteria, Phylum: Proteobacteria, Class: Alphaproteobacteria, Order: Sphingomonadales, Family: Sphingomonadaceae, Genus:
atacggagggggctagcgttgttcggaattactgggcgtaaagcgtacgtaggcggctttgtaagttagaggtgaaagcctggagctcaactccagaactgcctttaagactgcatcgcttgaatccaggagaggtgagtggaattccgagtgtagaggtgaaattcgtagatattcggaagaacaccagtggcgaaggcggctcactggactggtattgacgctgaggtacgaaagcgtggggagcaaacagg

SEQ ID NO: 845 - DNA, 251 bp, Unknown
  Kingdom: Bacteria, Phylum: Proteobacteria, Class: Alphaproteobacteria, Order: Sphingomonadales, Family: Sphingomonadaceae, Genus:
tacggagggggctagcgttgttcggaattactgggcgtaaagcgcacgtaggcggctttgtaagtcaggggtgaaagcctggagctcaactccagaactgcctttgagactgcatcgcttgaatccgggagaggtaagtggaattccgagtgtagaggtgaaattcgtagatattcggaagaacaccagtggcgaaggcggcttactggaccgattgacgctgaggtgcgaaagcgtggggagcaaacagg

SEQ ID NO: 846 - DNA, 254 bp, Unknown
  Kingdom: Bacteria, Phylum: Proteobacteria, Class: Alphaproteobacteria, Order: Sphingomonadales, Family: Sphingomonadaceae, Genus:
atacggagggggctagcgttgttcggaattactgggcgtaaagcgcacgtaggcggctttgtaagttagaggtgaaagcccggggctcaactccggaactgcctttaagactgcatcgctagaattgtggagaggtaagtggaattccgagtgtagaggtgaaattcgtagatattcggaagaacaccagtggcgaaggcgacttactggacacatattgacgctgaggtgcgaaagcgtggggagcaaacagg

SEQ ID NO: 847 - DNA, 254 bp, Unknown
  Kingdom: Bacteria, Phylum: Proteobacteria, Class: Alphaproteobacteria, Order: Sphingomonadales, Family: Sphingomonadaceae, Genus:
atacggagggggctagcgttgttcggaattactgggcgtaaagcgcacgtaggcggctttgtaagttagaggtgaaagcccggagctcaactccggaactgcctttaagactgcatcgctcgaacgtcggagaggtaagtggaattccgagtgtagaggtgaaattcgtagatattcggaagaacaccagtggcgaaggcgacttactggacgactgttgacgctgaggtgcgaaagcgtggggagcaaacagg

SEQ ID NO: 848 - DNA, 254 bp, Unknown
  Kingdom: Bacteria, Phylum: Proteobacteria, Class: Alphaproteobacteria, Order: Sphingomonadales, Family: Sphingomonadaceae, Genus:
atacggagggggctagcgttgttcggaattactgggcgtaaagcgcacgtaggcggctttgtaagtaagaggtgaaagcctggtgctcaacatcagaactgccttttagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacagg

SEQ ID NO: 849 - DNA, 254 bp, Unknown
  Kingdom: Bacteria, Phylum: Proteobacteria, Class: Alphaproteobacteria, Order: Sphingomonadales, Family: Sphingomonadaceae, Genus:
atacggagggggctagcgttgttcggaattactgggcgtaaagcgcacgtaggcggctttgcaagttagaggtgaaagcccggggctcaactccggaattgcctttaaaactgcatcgctagaattgtggagaggtaagtggaattccgagtgtagaggtgaaattcgtagatattcggaagaacaccagtggcgaaggcgacttactggacacatattgacgctgaggtgcgaaagcgtggggagcaaacagg

SEQ ID NO: 850 - DNA, 254 bp, Unknown
  Kingdom: Bacteria, Phylum: Proteobacteria, Class: Alphaproteobacteria, Order: Sphingomonadales, Family: Sphingomonadaceae, Genus:
atacggagggagctagcgttgttcggaattactgggcgtaaagcgcacgtaggcggctttgtaagttagaggtgaaagcctggagctcaactccagaactgcctttgatactgcatggcttgaatccaggagaggtgagtggaattccgagtgtagaggtgaaattcgtagatattcggaagaacaccagtggcgaaggcggctcactggactggtattgacgctgaggtgcgaaagcgtggggagcaaacagg

SEQ ID NO: 851 - DNA, 251 bp, Unknown
  Kingdom: Bacteria, Phylum: Proteobacteria, Class: Alphaproteobacteria, Order: Sphingomonadales, Family: Sphingomonadaceae, Genus:
tacggagggggctagcgttgttcggaattactgggcgtaaagcgcacgtaggcggcttggtaagttagaggtgaaagcctggagctcaactccagaattgcctttaagactgccgagctagcaggtgagagaggtaagtggaattccgagtgtagaggtgaaattcgtagatattcggaagaacaccagtggcgaaggcggcttactggctcactggacgctgaggtgcgaaagcgtggggagcaaacagg

SEQ ID NO: 852 - DNA, 254 bp, Unknown
  Kingdom: Bacteria, Phylum: Proteobacteria, Class: Alphaproteobacteria, Order: Sphingomonadales, Family: Sphingomonadaceae, Genus:
atacggagggagctagcgttgttcggaattactgggcgtaaagcgcacgtaggcggctttgtaagttagaggtgaaagcctggagctcaactccagaattgcctttaagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacagg

SEQ ID NO: 853 - DNA, 251 bp, Unknown
  Kingdom: Bacteria, Phylum: Proteobacteria, Class: Alphaproteobacteria, Order: Sphingomonadales, Family: Sphingomonadaceae, Genus:
tacggagggagctagcgttgttcggaattactgggcgtaaagcgcacgtaggcggctttgtaagttagaggtgaaagcctggagctcaactccagaattgcctttaagactgcatcgctcgaatccaggagaggtgagtggaattccgagtgtagaggtgaaattcgtagatattcggaagaacaccagtggcgaaggcggctcactggactgattgacgctgaggtgcgaaagcgtggggagcaaacagg

SEQ ID NO: 854 - DNA, 254 bp, Unknown
  Kingdom: Bacteria, Phylum: Proteobacteria, Class: Alphaproteobacteria, Order: Sphingomonadales, Family: Sphingomonadaceae, Genus:
atacggagggggctagcgttgttcggaattactgggcgtaaagcgcacgtaggcggctttgtaagtcaggggtgaaagcctggagctcaactccagaactgcctttgagactgcatcgcttgaatccgggagaggtaagtggaattccgagtgtagaggtgaaattcgtagatattcggaagaacaccagtggcgaaggcggcttactggaccggaattgacgctgaggtgcgaaagcgtggggagcaaacagg

SEQ ID NO: 855 - DNA, 254 bp, Unknown
  Kingdom: Bacteria, Phylum: Proteobacteria, Class: Alphaproteobacteria, Order: Sphingomonadales, Family: Sphingomonadaceae, Genus:
atacggagggagctagcgttgttcggaattactgggcgtaaagcgcacgtaggcggctttgtaagttagaggtgaaagcctggagctcaactccagaattgcctttaagactgcatcgctcgaatccaggagaggtgagtggaattccgagtgtagaggtgaaattcgtagatattcggaagaacaccagtggcgaaggcggctcactggactggtattgacgctgaggtgcgaaagcgtggggagcaaacagg

SEQ ID NO: 856 - DNA, 254 bp, Unknown
  Kingdom: Bacteria, Phylum: Proteobacteria, Class: Alphaproteobacteria, Order: Sphingomonadales, Family: Sphingomonadaceae, Genus:
atacggagggagctagcgttgttcggaattactgggcgtaaagcgcgcgtaggcggttttttaagtcagaggtgaaagcccggggctcaaccccggaattgcctttgaaactggaaaacttgaatcttggagaggtcagtggaattccgagtgtagaggtgaaattcgtagatattcggaagaacaccagtggcgaaggcgactgactggacaagtattgacgctgaggtgcgaaagcgtggggagcaaacagg

SEQ ID NO: 857 - DNA, 254 bp, Unknown
  Kingdom: Bacteria, Phylum: Proteobacteria, Class: Alphaproteobacteria, Order: Sphingomonadales, Family: Sphingomonadaceae, Genus:
atacggagggggctagcgttgttcggaattactgggcgtaaagcgcacgtaggcggctttgtaagttagaggtgaaagcccggagctcaactccggaactgcctttaagactgcatcgcttgaacgtcggagaggtaagtggaattccgagtgtagaggtgaaattcgtagatattcggaagaacaccagtggcgaaggcgacttactggacgactgttgacgctgaggtgcgaaagcgtggggagcaaacagg

SEQ ID NO: 858 - DNA, 254 bp, Unknown
  Kingdom: Bacteria, Phylum: Proteobacteria, Class: Alphaproteobacteria, Order: Sphingomonadales, Family: Sphingomonadaceae, Genus:
atacggagggagctagcgttgttcggaattactgggcgtaaagcgcacgtaggcggctactcaagtcagaggtgaaagcccggggctcaaccccggaactgcctttgaaactaggtagctggaatcttggagaggtcagtggaattccgagtgtagaggtgaaattcgtagatattcggaagaacaccagtggcgaaggcgactgactggacaagtattgacgctgaggtgcgaaagcgtggggagcaaacagg

SEQ ID NO: 859 - DNA, 254 bp, Unknown
  Kingdom: Bacteria, Phylum: Proteobacteria, Class: Alphaproteobacteria, Order: Sphingomonadales, Family: Sphingomonadaceae, Genus:
atacggagggggctagcgttgttcggaattactgggcgtaaagcgcacgtaggcggctttgtaagttagaggtgaaagcccggggctcaaccccggaattgcctttaagactgcatcgcttgaacgtcggagaggtgagtggaattccgagtgtagaggtgaaattcgtagatattcggaagaacaccagtggcgaaggcggctcactggacgactgttgacgctgaggtgcgaaagcgtggggagcaaacagg

SEQ ID NO: 860 - DNA, 254 bp, Unknown
  Kingdom: Bacteria, Phylum: Proteobacteria, Class: Alphaproteobacteria, Order: Sphingomonadales, Family:  , Genus:
atacggagggagctagcgttgttcggaattactgggcgtaaagcgcgcgtaggcggttactcaagtcagaggtgaaagcccggggctcaaccccggaactgcctttgaaactaggtgactagaatcttggagaggtcagtggaattccgagtgtagaggtgaaattcgtagatattcggaagaacaccagtggcgaaggcgactgactggacaagtattgacgctgaggtgcgaaagcgtggggagcaaacagg

SEQ ID NO: 861 - DNA, 254 bp, Unknown
  Kingdom: Bacteria, Phylum: Proteobacteria, Class: Alphaproteobacteria, Order: Sphingomonadales, Family:  , Genus:
atacggagggggctagcgttgttcggaattactgggcgtaaagcgcacgtaggcggctttgtaagttagaggtgaaagcctggagctcaactccagaattgcctttaagactgcatcgcttgaatccaggagaggtgagtggaattccgagtgtagaggtgaaattcgtagatattcggaagaacaccagtggcgaaggcggctcactggactggtattgacgctgaggtgcgaaagcgtggggagcaaacagg

SEQ ID NO: 862 - DNA, 251 bp, Unknown
  Kingdom: Bacteria, Phylum: Proteobacteria, Class: Alphaproteobacteria, Order:  , Family:  , Genus:
tacgaagggggctagcgttgttcggatttactgggcgtaaagggcacgcaggcggcctgtcaagttgggggtgaaatcccggggctcaaccccggaactgcctccaaaactgtcaggctagagatcgagagaggtgagtggaattcctagtgtagaggtgaaattcgtagatattaggaggaacaccagtggcgaaggcggctcactggctcgtctgacgctcaggtgcgaaagcgtggggagcaaacagg

SEQ ID NO: 863 - DNA, 254 bp, Unknown
  Kingdom: Bacteria, Phylum: Proteobacteria, Class: Betaproteobacteria, Order: Burkholderiales, Family: Alcaligenaceae, Genus:
atacgtagggtgcaagcgttaatcggaattactgggcgtaaagcgtgcgcaggcggttcggaaagaaagatgtgaaatcccagggctcaaccttggaactgcatttttaactcccgaactagagtatgtcagaggggggtggaattccacgtgtagcagtgaaatgcgtagatatgtggaggaacaccgatggcgaaggcagccccctgggataatactgacgctcatgcacgaaagcgtggggagcaaacagg

SEQ ID NO: 864 - DNA, 254 bp, Unknown
  Kingdom: Bacteria, Phylum: Proteobacteria, Class: Betaproteobacteria, Order: Burkholderiales, Family: Alcaligenaceae, Genus:
atacgtagggtgcaagcgttaatcggaattactgggcgtaaagcgtgcgcaggcggttcggaaagaaagatgtgaaatcccagagcttaactttggaactgcatttttaactaccgagctagagtgtgtcagagggaggtggaattccgcgtgtagcagtgaaatgcgtagatatgcggaggaacaccgatggcgaaggcagcctcctgggataacactgacgctcatgcacgaaagcgtggggagcaaacagg

SEQ ID NO: 865 - DNA, 251 bp, Unknown
  Kingdom: Bacteria, Phylum: Proteobacteria, Class: Betaproteobacteria, Order: Burkholderiales, Family: Alcaligenaceae, Genus:
tacgtagggtgcaagcgttaatcggaattactgggcgtaaagcgtgcgcaggcggttcggaaagaaagatgtgaaatcccagggcttaaccttggaactgcatttttaactaccgggctagagtgtgtcagaggggggtggaattccacgtgtagcagtgaaatgcgtagatatgtggaggaacaccgatggcgaaggcagccccctgggataactgacgctcatgcacgaaagcgtggggagcaaacagg

SEQ ID NO: 866 - DNA, 251 bp, Unknown
  Kingdom: Bacteria, Phylum: Proteobacteria, Class: Betaproteobacteria, Order: Burkholderiales, Family: Burkholderiaceae, Genus:
tacgtagggtgcgagcgttaatcggaattactgggcgtaaagcgtgcgcaggcggtttgttaagacagatgtgaaatccccgggcttaacctgggaactgcatttgtgactggcaagctagagtatggcagaggggggtagaattccacgtgtagcagtgaaatgcgtagagatgtggaggaataccgatggcgaaggcagccccctgggccaactgacgctcatgcacgaaagcgtggggagcaaacagg

SEQ ID NO: 867 - DNA, 254 bp, Unknown
  Kingdom: Bacteria, Phylum: Proteobacteria, Class: Betaproteobacteria, Order: Burkholderiales, Family: Burkholderiaceae, Genus:
atacgtagggtgcgagcgttaatcggaattactgggcgtaaagcgtgcgcaggcggtttgctaagaccgatgtgaaatccccgggctcaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacagg

SEQ ID NO: 868 - DNA, 254 bp, Unknown
  Kingdom: Bacteria, Phylum: Proteobacteria, Class: Betaproteobacteria, Order: Burkholderiales, Family: Burkholderiaceae, Genus:
atacgtagggtgcgagcgttaatcggaattactgggcgtaaagcgtgcgcaggcggttcgctaagaccgatgtgaaatccccgggcttaacctgggaactgcattggtgactggcgagctagagtgtggcagaggggggtagaattccacgtgtagcagtgaaatgcgtagagatgtggaggaataccgatggcgaaggcagccccctgggctaacactgacgctcatgcacgaaagcgtggggagcaaacagg

SEQ ID NO: 869 - DNA, 254 bp, Unknown
  Kingdom: Bacteria, Phylum: Proteobacteria, Class: Betaproteobacteria, Order: Burkholderiales, Family: Burkholderiaceae, Genus:
atacgtagggtgcaagcgttaatcggaattactgggcgtaaagcgtgcgcaggcggttcgttaagacagatgtgaaatccccgggcttaacctgggaactgcatttgtgactggcggactcgagtatggcagaggggggtagaattccacgtgtagcagtgaaatgcgtagagatgtggaggaataccgatggcgaaggcagccccctgggccaatactgacgctcatgcacgaaagcgtggggagcaaacagg

SEQ ID NO: 870 - DNA, 254 bp, Unknown
  Kingdom: Bacteria, Phylum: Proteobacteria, Class: Betaproteobacteria, Order: Burkholderiales, Family: Burkholderiaceae, Genus:
atacgtagggtgcaagcgttaatcggaattactgggcgtaaagcgtgcgcaggcggtttgttaagaccgatgtgaaatccccgggctcaacctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacagg

SEQ ID NO: 871 - DNA, 251 bp, Unknown
  Kingdom: Bacteria, Phylum: Proteobacteria, Class: Betaproteobacteria, Order: Burkholderiales, Family: Burkholderiaceae, Genus:
tacgtagggtgcgagcgttaatcggaattactgggcgtaaagcgtgcgcaggcggtctgttaagacagatgtgaaatccccgggcttaacctgggaactgcatttgtgactggcaggctagagtatggcagaggggggtagaattccacgtgtagcagtgaaatgcgtagagatgtggaggaataccgatggcgaaggcagccccctgggccaactgacgctcatgcacgaaagcgtggggagcaaacagg

SEQ ID NO: 872 - DNA, 254 bp, Unknown
  Kingdom: Bacteria, Phylum: Proteobacteria, Class: Betaproteobacteria, Order: Burkholderiales, Family: Burkholderiaceae, Genus:
atacgtagggtgcaagcgttaatcggaattactgggcgtaaagcgtgcgcaggcggttcgttaagacagatgtgaaatccccgggcttaacctgggaactgcatttgtgactggcgggctagagtatggcagaggggggtagaattccacgtgtagcagtgaaatgcgtagagatgtggaggaataccgatggcgaaggcagccccctgggccaatactgacgctcatgcacgaaagcgtggggagcaaacagg

SEQ ID NO: 873 - DNA, 251 bp, Unknown
  Kingdom: Bacteria, Phylum: Proteobacteria, Class: Betaproteobacteria, Order: Burkholderiales, Family: Burkholderiaceae, Genus:
tacgtagggtgcaagcgttaatcggaattactgggcgtaaagcgtgcgcaggcggtccgttaagacagatgtgaaatccccgggcttaacctgggaactgcatttgtgactggcggactcgagtatggcagaggggggtagaattccacgtgtagcagtgaaatgcgtagagatgtggaggaataccgatggcgaaggcagccccctgggccaactgacgctcatgcacgaaagcgtggggagcaaacagg

SEQ ID NO: 874 - DNA, 254 bp, Unknown
  Kingdom: Bacteria, Phylum: Proteobacteria, Class: Betaproteobacteria, Order: Burkholderiales, Family: Burkholderiaceae, Genus:
atacgtagggtgcgagcgttaatcggaattactgggcgtaaagcgtgcgcaggcggtctgttaagaccgatgtgaaatccccgggcttaacctgggaactgcattggtgactggcaggctagagtgtggcagagggaggtagaattccacgtgtagcagtgaaatgcgtagagatgtggaggaataccgatggcgaaggcagcctcctgggccaacactgacgctcatgcacgaaagcgtggggagcaaacagg

SEQ ID NO: 875 - DNA, 251 bp, Unknown
  Kingdom: Bacteria, Phylum: Proteobacteria, Class: Betaproteobacteria, Order: Burkholderiales, Family: Burkholderiaceae, Genus:
tacgtagggtgcgagcgttaatcggaattactgggcgtaaagcgtgcgcaggcggtgatgtaagaccgatgtgaaatccccgggcttaacctgggaactgcattggtgactgcattgctggagtatggcagaggggggtggaattccacgtgtagcagtgaaatgcgtagagatgtggaggaacaccgatggcgaaggcagccccctgggccaactgacgctcatgcacgaaagcgtggggagcaaacagg

SEQ ID NO: 876 - DNA, 251 bp, Unknown
  Kingdom: Bacteria, Phylum: Proteobacteria, Class: Betaproteobacteria, Order: Burkholderiales, Family: Burkholderiaceae, Genus:
tacgtagggtgcaagcgttaatcggaattactgggcgtaaagcgtgcgcaggcggttcgttaagacagatgtgaaatccccgggcttaacctgggaactgcatttgtgactggcggactcgagtatggcagaggggggtagaattccacgtgtagcagtgaaatgcgtagagatgtggaggaataccgatggcgaaggcagccccctgggccaactgacgctcatgcacgaaagcgtggggagcaaacagg

SEQ ID NO: 877 - DNA, 254 bp, Unknown
  Kingdom: Bacteria, Phylum: Proteobacteria, Class: Betaproteobacteria, Order: Burkholderiales, Family: Burkholderiaceae, Genus:
atacgtagggtgcgagcgttaatcggaattactgggcgtaaagcgtgcgcaggcggtttgctaagaccgatgtgaaatccccgggcttaacctgggaactgcattggtgactggcaggctagagtgtggcagaggggggtagaattccacgtgtagcagtgaaatgcgtagagatgtggaggaataccgatggcgaaggcagccccctgggctaacactgacgctcatgcacgaaagcgtggggagcaaacagg

SEQ ID NO: 878 - DNA, 254 bp, Unknown
  Kingdom: Bacteria, Phylum: Proteobacteria, Class: Betaproteobacteria, Order: Burkholderiales, Family: Burkholderiaceae, Genus:
atacgtagggtccaagcgttaatcggaattactgggcgtaaagcgtgcgcaggcggttgtgcaagaccgatgtgaaatccccgagcttaacttgggaattgcattggtgactgcacggctagagtgtgtcagaggggggtagaattccacgtgtagcagtgaaatgcgtagagatgtggaggaataccgatggcgaaggcagccccctgggataacactgacgctcatgcacgaaagcgtggggagcaaacagg

SEQ ID NO: 879 - DNA, 254 bp, Unknown
  Kingdom: Bacteria, Phylum: Proteobacteria, Class: Betaproteobacteria, Order: Burkholderiales, Family: Burkholderiaceae, Genus:
atacgtagggtgcgagcgttaatcggaattactgggcgtaaagcgtgcgcaggcggttcgttaagacagatgtgaaatccccgggcttaacctgggaactgcatttgtgactggcgagctagagtatggcagaggggggtagaattccacgtgtagcagtgaaatgcgtagagatgtggaggaataccgatggcgaaggcagccccctgggccaatactgacgctcatgcacgaaagcgtggggagcaaacagg

SEQ ID NO: 880 - DNA, 254 bp, Unknown
  Kingdom: Bacteria, Phylum: Proteobacteria, Class: Betaproteobacteria, Order: Burkholderiales, Family: Burkholderiaceae, Genus:
atacgtagggtgcgagcgttaatcggaattactgggcgtaaagcgtgcgcaggcggtttgttaagaccgatgtgaaatccccgggctcaacctgggaactgcattggtgactggcaagctagagtatggcagaggggggtagaattccacgtgtagcagtgaaatgcgtagagatgtggaggaataccgatggcgaaggcagccccctgggccaatactgacgctcatgcacgaaagcgtggggagcaaacagg

SEQ ID NO: 881 - DNA, 254 bp, Unknown
  Kingdom: Bacteria, Phylum: Proteobacteria, Class: Betaproteobacteria, Order: Burkholderiales, Family: Burkholderiaceae, Genus:
atacgtagggtccaagcgttaatcggaattactgggcgtaaagcgtgcgcaggcggttgtgcaagaccgatgtgaaatccccgggcttaacctgggaattgcattggtgactgcacggctagagtgtgtcagaggggggtagaattccacgtgtagcagtgaaatgcgtagagatgtggaggaataccgatggcgaaggcagccccctgggataacactgacgctcatgcacgaaagcgtggggagcaaacagg

SEQ ID NO: 882 - DNA, 254 bp, Unknown
  Kingdom: Bacteria, Phylum: Proteobacteria, Class: Betaproteobacteria, Order: Burkholderiales, Family: Burkholderiaceae, Genus:
atacgtagggtgcgagcgttaatcggaattactgggcgtaaagcgtgcgcaggcggtctgttaagaccgatgtgaaatccccgggcttaacctgggaactgcattggtgactggcaggctagagtatggcagaggggggtagaattccacgtgtagcagtgaaatgcgtagagatgtggaggaataccgatggcgaaggcagccccctgggccaatactgacgctcatgcacgaaagcgtggggagcaaacagg

SEQ ID NO: 883 - DNA, 254 bp, Unknown
  Kingdom: Bacteria, Phylum: Proteobacteria, Class: Betaproteobacteria, Order: Burkholderiales, Family: Burkholderiaceae, Genus:
atacgtagggtgcaagcgttaatcggaattactgggcgtaaagcgtgcgcaggcggtccgctaagacagatgtgaaatccccgggcttaacctgggaactgcatttgtgactggcgggctagagtatggcagaggggggtagaattccacgtgtagcagtgaaatgcgtagagatgtggaggaataccgatggcgaaggcagccccctgggccaatactgacgctcatgcacgaaagcgtggggagcaaacagg

SEQ ID NO: 884 - DNA, 254 bp, Unknown
  Kingdom: Bacteria, Phylum: Proteobacteria, Class: Betaproteobacteria, Order: Burkholderiales, Family: Burkholderiaceae, Genus:
atacgtagggtgcaagcgttaatcggaattactgggcgtaaagcgtgcgcaggcggttcgctaagaccgatgtgaaatccccgggcttaacctgggaactgcattggtgactggcgggctagagtatggcagaggggggtagaattccacgtgtagcagtgaaatgcgtagagatgtggaggaataccgatggcgaaggcagccccctgggccaatactgacgctcatgcacgaaagcgtggggagcaaacagg

SEQ ID NO: 885 - DNA, 254 bp, Unknown
  Kingdom: Bacteria, Phylum: Proteobacteria, Class: Betaproteobacteria, Order: Burkholderiales, Family: Burkholderiaceae, Genus:
atacgtagggtgcgagcgttaatcggaattactgggcgtaaagcgtgcgcaggcggttttgtaagacaggcgtgaaatccccgagctcaacttgggaatggcgcttgtgactgcaaggctagagtatgtcagaggggggtagaattccacgtgtagcagtgaaatgcgtagagatgtggaggaataccgatggcgaaggcagccccctgggacgtcactgacgctcatgcacgaaagcgtggggagcaaacagg

SEQ ID NO: 886 - DNA, 254 bp, Unknown
  Kingdom: Bacteria, Phylum: Proteobacteria, Class: Betaproteobacteria, Order: Burkholderiales, Family: Burkholderiaceae, Genus:
atacgtagggtgcgagcgttaatcggaattactgggcgtaaagcgtgcgcaggcggttttgtaagacaggcgtgaaatccccgggctcaacctgggaattgcgcttgtgactgcaaggctagagtgcgtcagaggggggtagaattccacgtgtagcagtgaaatgcgtagagatgtggaggaataccgatggcgaaggcagccccctgggacgtgactgacgctcatgcacgaaagcgtggggagcaaacagg

SEQ ID NO: 887 - DNA, 255 bp, Unknown
  Kingdom: Bacteria, Phylum: Proteobacteria, Class: Betaproteobacteria, Order: Burkholderiales, Family: Burkholderiaceae, Genus:
atacgtagggtgcgagcgttaatcggaattactgggcgtaaagcgtgcgcaggcggtctgttaagaccgatgtgaaatccccgggcttaacctgggaactgcattggtgactggcaggctttgagtgtggcagagggaggtagaattccacgtgtagcagtgaaatgcgtagagatgtggaggaataccgatggcgaaggcagcctcctgggccaacactgacgctcatgcacgaaagcgtggggagcaaacagg

SEQ ID NO: 888 - DNA, 251 bp, Unknown
  Kingdom: Bacteria, Phylum: Proteobacteria, Class: Betaproteobacteria, Order: Burkholderiales, Family: Burkholderiaceae, Genus:
tacgtagggtgcgagcgttaatcggaattactgggcgtaaagcgtgcgcaggcggtgctgtaagaccgatgtgaaatccccgggcttaacctgggaactgcattggtgactgcagcgctggagtatggcagaggggggtggaattccacgtgtagcagtgaaatgcgtagagatgtggaggaacaccgatggcgaaggcagccccctgggccaactgacgctcatgcacgaaagcgtggggagcaaacagg

SEQ ID NO: 889 - DNA, 254 bp, Unknown
  Kingdom: Bacteria, Phylum: Proteobacteria, Class: Betaproteobacteria, Order: Burkholderiales, Family: Burkholderiaceae, Genus:
atacgtagggtgcaagcgttaatcggaattactgggcgtaaagcgtgcgcaggcggttcgctaagacagatgtgaaatccccgggcttaacctgggaactgcatttgtgactggcgggctagagtatggcagaggggggtagaattccacgtgtagcagtgaaatgcgtagagatgtggaggaataccgatggcgaaggcagccccctgggccaatactgacgctcatgcacgaaagcgtggggagcaaacagg

SEQ ID NO: 890 - DNA, 254 bp, Unknown
  Kingdom: Bacteria, Phylum: Proteobacteria, Class: Betaproteobacteria, Order: Burkholderiales, Family: Burkholderiaceae, Genus:
atacgtagggtgcaagcgttaatcggaattactgggcgtaaagcgtgcgcaggcggttttgtaagacggatgtgaaatccccgggcttaacctgggaactgcattcgtgactgcaaggctagagtatggcagaggggggtagaattccacgtgtagcagtgaaatgcgtagagatgtggaggaataccgatggcgaaggcagccccctgggccaatactgacgctcatgcacgaaagcgtggggagcaaacagg

SEQ ID NO: 891 - DNA, 254 bp, Unknown
  Kingdom: Bacteria, Phylum: Proteobacteria, Class: Betaproteobacteria, Order: Burkholderiales, Family: Comamonadaceae, Genus: Acidovorax
atacgtagggtgcgagcgttaatcggaattactgggcgtaaagcgtgcgcaggcggttatgtaagacagatgtgaaatccccgggctcaacctgggaactgcatttgtgactgtatagctagagtacggtagagggggatggaattccgcgtgtagcagtgaaatgcgtagatatgcggaggaacaccgatggcgaaggcaatcccctggacctgtactgacgctcatgcacgaaagcgtggggagcaaacagg

SEQ ID NO: 892 - DNA, 254 bp, Unknown
  Kingdom: Bacteria, Phylum: Proteobacteria, Class: Betaproteobacteria, Order: Burkholderiales, Family: Comamonadaceae, Genus:
atacgtagggtgcgagcgttaatcggaattactgggcgtaaagcgtgcgcaggcggctttgcaagacagaggtgaaatccccgggctcaacctgggaactgcctttgtgactgcaaggctagagtacggcagagggggatggaattccgcgtgtagcagtgaaatgcgtagatatgcggaggaacaccaatggcgaaggcaatcccctgggcctgtactgacgctcatgcacgaaagcgtggggagcaaacagg

SEQ ID NO: 893 - DNA, 254 bp, Unknown
  Kingdom: Bacteria, Phylum: Proteobacteria, Class: Betaproteobacteria, Order: Burkholderiales, Family: Comamonadaceae, Genus:
atacgtagggtgcaagcgttaatcggaattactgggcgtaaagcgtgcgcaggcggttatataagacagatgtgaaatccccgggctcaacctgggaactgcatttgtgactgtatagctagagtacggtagagggggatggaattccgcgtgtagcagtgaaatgcgtagatatgcggaggaacaccgatggcgaaggcaatcccctggacctgtactgacgctcatgcacgaaagcgtggggagcaaacagg

SEQ ID NO: 894 - DNA, 254 bp, Unknown
  Kingdom: Bacteria, Phylum: Proteobacteria, Class: Betaproteobacteria, Order: Burkholderiales, Family: Comamonadaceae, Genus:
atacgtagggtgcaagcgttaatcggaattactgggcgtaaagcgtgcgcaggcggttatgtaagacagatgtgaaatccccgggctcaacctgggaactgcatttgtgactgcatagctagagtacggtagagggggatggaattccgcgtgtagcagtgaaatgcgtagatatgcggaggaacaccgatggcgaaggcaatcccctggacctgtactgacgctcatgcacgaaagcgtggggagcaaacagg

SEQ ID NO: 895 - DNA, 254 bp, Unknown
  Kingdom: Bacteria, Phylum: Proteobacteria, Class: Betaproteobacteria, Order: Burkholderiales, Family: Comamonadaceae, Genus:
atacgtagggtgcaagcgttaatcggaattactgggcgtaaagcgtgcgcaggcggtgatgtaagacagttgtgaaatccccgggctcaacctgggaactgcatctgtgactgcatcgctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacagg

SEQ ID NO: 896 - DNA, 254 bp, Unknown
  Kingdom: Bacteria, Phylum: Proteobacteria, Class: Betaproteobacteria, Order: Burkholderiales, Family: Comamonadaceae, Genus:
atacgtagggtgcaagcgttaatcggaattactgggcgtaaagcgtgcgcaggcggttttgtaagacaggcgtgaaatccccgggcttaacctgggaatggcgcttgtgactgcaaagctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacagg

SEQ ID NO: 897 - DNA, 254 bp, Unknown
  Kingdom: Bacteria, Phylum: Proteobacteria, Class: Betaproteobacteria, Order: Burkholderiales, Family: Comamonadaceae, Genus:
atacgtagggtgcaagcgttaatcggaattactgggcgtaaagcgtgcgcaggcggttatgcaagacagatgtgaaatccccgggctcaacctgggaactgcatttgtgactgcatagctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacagg

SEQ ID NO: 898 - DNA, 254 bp, Unknown
  Kingdom: Bacteria, Phylum: Proteobacteria, Class: Betaproteobacteria, Order: Burkholderiales, Family: Comamonadaceae, Genus:
atacgtagggtgcaagcgttaatcggaattactgggcgtaaagcgtgcgcaggcggtgatgcaagacagaggtgaaatccccgggctcaacctgggaactgcctttgtgactgcatgactagagtacggtagagggggatggaattccgcgtgtagcagtgaaatgcgtagatatgcggaggaacaccgatggcgaaggcaatcccctggacctgtactgacgctcatgcacgaaagcgtggggagcaaacagg

SEQ ID NO: 899 - DNA, 254 bp, Unknown
  Kingdom: Bacteria, Phylum: Proteobacteria, Class: Betaproteobacteria, Order: Burkholderiales, Family: Comamonadaceae, Genus:
atacgtagggtgcaagcgttaatcggaattactgggcgtaaagcgtgcgcaggcggttatgcaagacagatgtgaaatccccgggctcaacctgggaactgcatttgtgactgcatggctagagtacggcagagggggatggaattccgcgtgtagcagtgaaatgcgtagatatgcggaggaacaccgatggcgaaggcaatcccctgggcctgtactgacgctcatgcacgaaagcgtggggagcaaacagg

SEQ ID NO: 900 - DNA, 254 bp, Unknown
  Kingdom: Bacteria, Phylum: Proteobacteria, Class: Betaproteobacteria, Order: Burkholderiales, Family: Comamonadaceae, Genus:
atacgtagggtgcaagcgttaatcggaattactgggcgtaaagcgtgcgcaggcggttgtgcaagacagatgtgaaatccccgggctcaacctgggaactgcatttgtgactgcacggctagagtgcggcagagggagatggaattccgcgtgtagcagtgaaatgcgtagatatgcggaggaacaccgatggcgaaggcaatctcctgggcctgcactgacgctcatgcacgaaagcgtggggagcaaacagg

SEQ ID NO: 901 - DNA, 254 bp, Unknown
  Kingdom: Bacteria, Phylum: Proteobacteria, Class: Betaproteobacteria, Order: Burkholderiales, Family: Comamonadaceae, Genus:
atacgtagggtgcaagcgttaatcggaattactgggcgtaaagcgtgcgcaggcggttatgtaagacagatgtgaaatccccgggcttaacctgggaactgcatttgtgactgcatagctagagtacggtagagggggatggaattccgcgtgtagcagtgaaatgcgtagatatgcggaggaacaccgatggcgaaggcaatcccctggacctgtactgacgctcatgcacgaaagcgtggggagcaaacagg

SEQ ID NO: 902 - DNA, 254 bp, Unknown
  Kingdom: Bacteria, Phylum: Proteobacteria, Class: Betaproteobacteria, Order: Burkholderiales, Family: Comamonadaceae, Genus:
atacgtagggtgcaagcgttaatcggaattactgggcgtaaagcgtgcgcaggcggttgtgcaagacagatgtgaaatccccgggcttaacctgggaactgcatttgtgactgcacggctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacagg

SEQ ID NO: 903 - DNA, 254 bp, Unknown
  Kingdom: Bacteria, Phylum: Proteobacteria, Class: Betaproteobacteria, Order: Burkholderiales, Family: Comamonadaceae, Genus:
atacgtagggtgcaagcgttaatcggaattactgggcgtaaagcgtgcgcaggcggtgatgtaagacagttgtgaaatccccgggctcaacctgggaactgcatctgtgactgcatcgctggagtacggcagagggggatggaattccgcgtgtagcagtgaaatgcgtagatatgcggaggaacaccgatggcgaaggcaatcccctgggcctgtactgacgctcatgcacgaaagcgtggggagcaaacagg

SEQ ID NO: 904 - DNA, 254 bp, Unknown
  Kingdom: Bacteria, Phylum: Proteobacteria, Class: Betaproteobacteria, Order: Burkholderiales, Family: Comamonadaceae, Genus:
atacgtagggtgcaagcgttaatcggaattactgggcgtaaagcgtgcgcaggcggtaatgtaagacagttgtgaaatccccgggctcaacctgggaactgcatctgtgactgcattgctggagtacggtagagggggatggaattccgcgtgtagcagtgaaatgcgtagatatgcggaggaacaccgatggcgaaggcaatcccctggacctgtactgacgctcatgcacgaaagcgtggggagcaaacagg

SEQ ID NO: 905 - DNA, 254 bp, Unknown
  Kingdom: Bacteria, Phylum: Proteobacteria, Class: Betaproteobacteria, Order: Burkholderiales, Family: Comamonadaceae, Genus:
atacgtagggtgcgagcgttaatcggaattactgggcgtaaagcgtgcgcaggcggtaatgtaagacagatgtgaaatccccgggctcaacctgggacctgcatttgtgactgcattgctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacagg

SEQ ID NO: 906 - DNA, 254 bp, Unknown
  Kingdom: Bacteria, Phylum: Proteobacteria, Class: Betaproteobacteria, Order: Burkholderiales, Family: Comamonadaceae, Genus:
atacgtagggtgcgagcgttaatcggaattactgggcgtaaagcgtgcgcaggcggttatataagacagttgtgaaatccccgggctcaacctgggaattgcatttgtgactgtatagctagagtacggtagagggggatggaattccgcgtgtagcagtgaaatgcgtagatatgcggaggaacaccgatggcgaaggcaatcccctggacctgtactgacgctcatgcacgaaagcgtggggagcaaacagg

SEQ ID NO: 907 - DNA, 254 bp, Unknown
  Kingdom: Bacteria, Phylum: Proteobacteria, Class: Betaproteobacteria, Order: Burkholderiales, Family: Comamonadaceae, Genus:
atacgtagggtgcaagcgttaatcggaattactgggcgtaaagcgtgcgcaggcggtaatgtaagacagatgtgaaatccccgggctcaacctgggaactgcatttgtgactgcattgctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacagg

SEQ ID NO: 908 - DNA, 254 bp, Unknown
  Kingdom: Bacteria, Phylum: Proteobacteria, Class: Betaproteobacteria, Order: Burkholderiales, Family: Comamonadaceae, Genus:
atacgtagggtgcaagcgttaatcggaattactgggcgtaaagcgtgcgcaggcggttatgcaagacagaggtgaaatccccgggctcaacctgggaactgcctttgtgactgcatagctagagtgcggcagagggggatggaattccgcgtgtagcagtgaaatgcgtagatatgcggaggaacaccgatggcgaaggcaatcccctgggcctgcactgacgctcatgcacgaaagcgtggggagcaaacagg

SEQ ID NO: 909 - DNA, 251 bp, Unknown
  Kingdom: Bacteria, Phylum: Proteobacteria, Class: Betaproteobacteria, Order: Burkholderiales, Family: Comamonadaceae, Genus:
tacgtagggtgcgagcgttaatcggaattactgggcgtaaagcgtgcgcaggcggtaatgtaagacagatgtgaaatccccgggctcaacctgggacctgcatttgtgactgcattgctggagtgcggcagagggggatggaattccgcgtgtagcagtgaaatgcgtagatatgcggaggaacaccgatggcgaaggcaatcccctgggcctactgacgctcatgcacgaaagcgtggggagcaaacagg

SEQ ID NO: 910 - DNA, 251 bp, Unknown
  Kingdom: Bacteria, Phylum: Proteobacteria, Class: Betaproteobacteria, Order: Burkholderiales, Family: Comamonadaceae, Genus:
tacgtagggtgcgagcgttaatcggaattactgggcgtaaagcgtgcgcaggcggtgatgtaagacaggtgtgaaatccccgggcttaacctgggaactgcatttgtgactgcatcgctggagtgcggcagagggggatggaattccgcgtgtagcagtgaaatgcgtagatatgcggaggaacaccgatggcgaaggcaatcccctgggcctactgacgctcatgcacgaaagcgtggggagcaaacagg

SEQ ID NO: 911 - DNA, 254 bp, Unknown
  Kingdom: Bacteria, Phylum: Proteobacteria, Class: Betaproteobacteria, Order: Burkholderiales, Family: Comamonadaceae, Genus:
atacgtagggtgcgagcgttaatcggaattactgggcgtaaagcgtgcgcaggcggttatgtaagacagatgtgaaatccccgggctcaacctgggaactgcatttgtgactgcatagctagagtacggcagagggggatggaattccgcgtgtagcagtgaaatgcgtagatatgcggaggaacaccgatggcgaaggcaatcccctgggcctgtactgacgctcatgcacgaaagcgtggggagcaaacagg

SEQ ID NO: 912 - DNA, 254 bp, Unknown
  Kingdom: Bacteria, Phylum: Proteobacteria, Class: Betaproteobacteria, Order: Burkholderiales, Family: Comamonadaceae, Genus:
atacgtagggtgcaagcgttaatcggaattactgggcgtaaagcgtgcgcaggcggttatataagacagatgtgaaatccccgggctcaacctgggaactgcatttgtgactgtatagctggagtacggcagagggggatggaattccgcgtgtagcagtgaaatgcgtagatatgcggaggaacaccgatggcgaaggcaatcccctgggcctgtactgacgctcatgcacgaaagcgtggggagcaaacagg

SEQ ID NO: 913 - DNA, 254 bp, Unknown
  Kingdom: Bacteria, Phylum: Proteobacteria, Class: Betaproteobacteria, Order: Burkholderiales, Family: Comamonadaceae, Genus:
atacgtagggtgcaagcgttaatcggaattactgggcgtaaagcgtgcgcaggcggctttgcaagacagatgtgaaatccccgggcttaacctgggaactgcatttgtgactgcatggctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacagg

SEQ ID NO: 914 - DNA, 254 bp, Unknown
  Kingdom: Bacteria, Phylum: Proteobacteria, Class: Betaproteobacteria, Order: Burkholderiales, Family: Comamonadaceae, Genus:
atacgtagggtgcgagcgttaatcggaattactgggcgtaaagcgtgcgcaggcggctttgcaagacagaggtgaaatccccgggctcaacctgggaactgcctttgtgactgcaaggctagagtacggcagagggggatggaattccgcgtgtagcagtgaaatgcgtagatatgcggaggaacaccgatggcgaaggcaatcccctgggcctgtactgacgctcatgcacgaaagcgtggggagcaaacagg

SEQ ID NO: 915 - DNA, 251 bp, Unknown
  Kingdom: Bacteria, Phylum: Proteobacteria, Class: Betaproteobacteria, Order: Burkholderiales, Family: Comamonadaceae, Genus:
tacgtagggtgcaagcgttaatcggaattactgggcgtaaagcgtgcgcaggcggtgatgtaagacaggtgtgaaatccccgggcttaacctgggaactgcatttgtgactgcatcgctggagtgcggcagagggggatggaattccgcgtgtagcagtgaaatgcgtagatatgcggaggaacaccgatggcgaaggcaatcccctgggcctactgacgctcatgcacgaaagcgtggggagcaaacagg

SEQ ID NO: 916 - DNA, 251 bp, Unknown
  Kingdom: Bacteria, Phylum: Proteobacteria, Class: Betaproteobacteria, Order: Burkholderiales, Family: Comamonadaceae, Genus:
tacgtagggtgcaagcgttaatcggaattactgggcgtaaagcgtgcgcaggcggtaatgtaagacagatgtgaaatccccgggctcaacctgggaactgcatttgtgactgcattgctggagtgcggcagagggggatggaattccgcgtgtagcagtgaaatgcgtagatatgcggaggaacaccgatggcgaaggcaatcccctgggcctactgacgctcatgcacgaaagcgtggggagcaaacagg

SEQ ID NO: 917 - DNA, 254 bp, Unknown
  Kingdom: Bacteria, Phylum: Proteobacteria, Class: Betaproteobacteria, Order: Burkholderiales, Family: Comamonadaceae, Genus:
atacgtagggtgcaagcgttaatcggaattactgggcgtaaagcgtgcgcaggcggttctataagacagatgtgaaatccccgggctcaacctgggaactgcatttgtgactgtagagctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacagg

SEQ ID NO: 918 - DNA, 254 bp, Unknown
  Kingdom: Bacteria, Phylum: Proteobacteria, Class: Betaproteobacteria, Order: Burkholderiales, Family: Comamonadaceae, Genus:
atacgtagggtgcgagcgttaatcggaattactgggcgtaaagcgtgcgcaggtggtcatgtaagacagatgtgaaatccccgggcttaacctgggaattgcatttgtgactgcatggctagagtgtggcagagggggatggaattccgcgtgtagcagtgaaatgcgtagatatgcggaggaacaccgatggcgaaggcagtcccctgggcctgcactgacactcaagcacgaaagcgtgaggagcaaacagg

SEQ ID NO: 919 - DNA, 254 bp, Unknown
  Kingdom: Bacteria, Phylum: Proteobacteria, Class: Betaproteobacteria, Order: Burkholderiales, Family: Comamonadaceae, Genus:
atacgtagggtgcgagcgttaatcggaattactgggcgtaaagcgtgcgcaggcggttatataagacagttgtgaaatccccgggctcaacctgggaattgcatctgtgactgtatagctagagtacggtagagggggatggaattccgcgtgtagcagtgaaatgcgtagatatgcggaggaacaccgatggcgaaggcaatcccctggacctgtactgacgctcatgcacgaaagcgtggggagcaaacagg

SEQ ID NO: 920 - DNA, 254 bp, Unknown
  Kingdom: Bacteria, Phylum: Proteobacteria, Class: Betaproteobacteria, Order: Burkholderiales, Family: Comamonadaceae, Genus:
atacgtagggtgcgagcgttaatcggaattactgggcgtaaagcgtgcgcaggcggtgatgtaagacagatgtgaaatccccgggctcaacctgggacctgcatttgtgactgcatcgctagagtacggcagagggggatggaattccgcgtgtagcagtgaaatgcgtagatatgcggaggaacaccgatggcgaaggcaatcccctgggcctgtactgacgctcatgcacgaaagcgtggggagcaaacagg

SEQ ID NO: 921 - DNA, 254 bp, Unknown
  Kingdom: Bacteria, Phylum: Proteobacteria, Class: Betaproteobacteria, Order: Burkholderiales, Family: Comamonadaceae, Genus:
atacgtagggtgcaagcgttaatcggaattactgggcgtaaagcgtgcgcaggcggtgatgtaagacagatgtgaaatccccgggctcaacctgggaactgcatttgtgactgcatcgctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacagg

SEQ ID NO: 922 - DNA, 254 bp, Unknown
  Kingdom: Bacteria, Phylum: Proteobacteria, Class: Betaproteobacteria, Order: Burkholderiales, Family: Comamonadaceae, Genus:
atacgtagggtgcaagcgttaatcggaattactgggcgtaaagcgtgcgcaggcggttctataagacagatgtgaaatccccgggctcaacctgggaactgcatttgtgactgtagagctggagtacggcagagggggatggaattccgcgtgtagcagtgaaatgcgtagatatgcggaggaacaccgatggcgaaggcaatcccctgggcctgtactgacgctcatgcacgaaagcgtggggagcaaacagg

SEQ ID NO: 923 - DNA, 254 bp, Unknown
  Kingdom: Bacteria, Phylum: Proteobacteria, Class: Betaproteobacteria, Order: Burkholderiales, Family: Comamonadaceae, Genus:
atacgtagggtgcgagcgttaatcggaattactgggcgtaaagcgtgcgcaggcggttatataagtcagatgtgaaatccccgggctcaacctgggacctgcatttgagactgtatagctagagtacggtagagggggatggaattccgcgtgtagcagtgaaatgcgtagatatgcggaggaacaccgatggcgaaggcaatcccctggacctgtactgacgctcatgcacgaaagcgtggggagcaaacagg

SEQ ID NO: 924 - DNA, 254 bp, Unknown
  Kingdom: Bacteria, Phylum: Proteobacteria, Class: Betaproteobacteria, Order: Burkholderiales, Family: Comamonadaceae, Genus:
atacgtagggtgcgagcgttaatcggaattactgggcgtaaagcgtgcgcaggcggctttgcaagacagatgtgaaatccccgggcttaacctgggaactgcatttgtgactgcaaggctagagtacggtagagggggatggaattccgcgtgtagcagtgaaatgcgtagatatgcggaggaacaccgatggcgaaggcaatcccctggacctgtactgacgctcatgcacgaaagcgtggggagcaaacagg

SEQ ID NO: 925 - DNA, 254 bp, Unknown
  Kingdom: Bacteria, Phylum: Proteobacteria, Class: Betaproteobacteria, Order: Burkholderiales, Family: Comamonadaceae, Genus:
atacgtagggtgcaagcgttaatcggaattactgggcgtaaagcgtgcgcaggcggctatgcaagacagatgtgaaatccccgggctcaacctgggaactgcatttgtgactgcatggctagagtacggtagagggggatggaattccgcgtgtagcagtgaaatgcgtagatatgcggaggaacaccgatggcgaaggcaatcccctggacctgtactgacgctcatgcacgaaagcgtggggagcaaacagg

SEQ ID NO: 926 - DNA, 254 bp, Unknown
  Kingdom: Bacteria, Phylum: Proteobacteria, Class: Betaproteobacteria, Order: Burkholderiales, Family: Comamonadaceae, Genus:
atacgtagggtgcaagcgttaatcggaattactgggcgtaaagcgtgcgcaggcggtgatgtaagacaggtgtgaaatccccgggcttaacctgggaactgcatttgtgactgcatcgctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacagg

SEQ ID NO: 927 - DNA, 254 bp, Unknown
  Kingdom: Bacteria, Phylum: Proteobacteria, Class: Betaproteobacteria, Order: Burkholderiales, Family: Comamonadaceae, Genus:
atacgtagggtgcaagcgttaatcggaattactgggcgtaaagcgtgcgcaggcggttatgtaagacagatgtgaaatccccgggctcaacctgggaactgcatttgtgactgcatagctagagtacggcagagggggatggaattccgcgtgtagcagtgaaatgcgtagatatgcggaggaacaccgatggcgaaggcaatcccctgggcctgtactgacgctcatgcacgaaagcgtggggagcaaacagg

SEQ ID NO: 928 - DNA, 254 bp, Unknown
  Kingdom: Bacteria, Phylum: Proteobacteria, Class: Betaproteobacteria, Order: Burkholderiales, Family: Comamonadaceae, Genus:
atacgtagggtgcaagcgttaatcggaattactgggcgtaaagcgtgcgcaggcggtaatgtaagacagttgtgaaatccccgggctcaacctgggaactgcatctgtgactgcattgctggagtacggcagagggggatggaattccgcgtgtagcagtgaaatgcgtagatatgcggaggaacaccgatggcgaaggcaatcccctgggcctgtactgacgctcatgcacgaaagcgtggggagcaaacagg

SEQ ID NO: 929 - DNA, 254 bp, Unknown
  Kingdom: Bacteria, Phylum: Proteobacteria, Class: Betaproteobacteria, Order: Burkholderiales, Family: Comamonadaceae, Genus:
atacgtagggtgcgagcgttaatcggaattactgggcgtaaagcgtgcgcaggcggttatgtaagacagttgtgaaatccccgggctcaacctgggaattgcatctgtgactgcatagctagagtacggtagagggggatggaattccgcgtgtagcagtgaaatgcgtagatatgcggaggaacaccgatggcgaaggcaatcccctggacctgtactgacgctcatgcacgaaagcgtggggagcaaacagg

SEQ ID NO: 930 - DNA, 254 bp, Unknown
  Kingdom: Bacteria, Phylum: Proteobacteria, Class: Betaproteobacteria, Order: Burkholderiales, Family: Comamonadaceae, Genus:
atacgtagggtgcaagcgttaatcggaattactgggcgtaaagcgtgcgcaggcggctttgcaagacagatgtgaaatccccgggctcaacctgggaactgcatttgtgactgcaaggctagagtacggtagagggggatggaattccgcgtgtagcagtgaaatgcgtagatatgcggaggaacaccgatggcgaaggcaatcccctggacctgtactgacgctcatgcacgaaagcgtggggagcaaacagg

SEQ ID NO: 931 - DNA, 254 bp, Unknown
  Kingdom: Bacteria, Phylum: Proteobacteria, Class: Betaproteobacteria, Order: Burkholderiales, Family: Comamonadaceae, Genus:
atacgtagggtgcaagcgttaatcggaattactgggcgtaaagcgtgcgcaggcggttatgcaagacagatgtgaaatccccgggctcaacctgggaactgcatttgtgactgcatggctagagtacggtagagggggatggaattccgcgtgtagcagtgaaatgcgtagatatgcggaggaacaccgatggcgaaggcaatcccctggacctgtactgacgctcatgcacgaaagcgtggggagcaaacagg

SEQ ID NO: 932 - DNA, 254 bp, Unknown
  Kingdom: Bacteria, Phylum: Proteobacteria, Class: Betaproteobacteria, Order: Burkholderiales, Family: Comamonadaceae, Genus:
atacgtagggtgcaagcgttaatcggaattactgggcgtaaagcgtgcgcaggcggtgatgtaagacagttgtgaaatccccgggctcaacctgggaactgcatctgtgactgcattgctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacagg

SEQ ID NO: 933 - DNA, 254 bp, Unknown
  Kingdom: Bacteria, Phylum: Proteobacteria, Class: Betaproteobacteria, Order: Burkholderiales, Family: Comamonadaceae, Genus:
atacgtagggtgcaagcgttaatcggaattactgggcgtaaagcgtgcgcaggcggttatataagacagatgtgaaatccccgggctcaacctgggacctgcatttgtgactgtatagctagagtacggtagagggggatggaattccgcgtgtagcagtgaaatgcgtagatatgcggaggaacaccgatggcgaaggcaatcccctggacctgtactgacgctcatgcacgaaagcgtggggagcaaacagg

SEQ ID NO: 934 - DNA, 254 bp, Unknown
  Kingdom: Bacteria, Phylum: Proteobacteria, Class: Betaproteobacteria, Order: Burkholderiales, Family: Comamonadaceae, Genus:
atacgtagggtgcaagcgttaatcggaattactgggcgtaaagcgtgcgcaggcggctttgcaagacagatgtgaaatccccgggctcaacctgggaactgcatttgtgactgcatggctagagtacggtagagggggatggaattccgcgtgtagcagtgaaatgcgtagatatgcggaggaacaccgatggcgaaggcaatcccctggacctgtactgacgctcatgcacgaaagcgtggggagcaaacagg

SEQ ID NO: 935 - DNA, 254 bp, Unknown
  Kingdom: Bacteria, Phylum: Proteobacteria, Class: Betaproteobacteria, Order: Burkholderiales, Family: Comamonadaceae, Genus:
atacgtagggtgcaagcgttaatcggaattactgggcgtaaagcgtgcgcaggcggttatgtaagacagttgtgaaatccccgggctcaacctgggaactgcatctgtgactgcatagctagagtacggtagagggggatggaattccgcgtgtagcagtgaaatgcgtagatatgcggaggaacaccgatggcgaaggcaatcccctggacctgtactgacgctcatgcacgaaagcgtggggagcaaacagg

SEQ ID NO: 936 - DNA, 254 bp, Unknown
  Kingdom: Bacteria, Phylum: Proteobacteria, Class: Betaproteobacteria, Order: Burkholderiales, Family: Comamonadaceae, Genus:
atacgtagggtgcaagcgttaatcggaattactgggcgtaaagcgtgcgcaggcggttatgcaagacagatgtgaaatccccgggctcaacctgggaactgcatttgtgactgcatagctagagtacggtagagggggatggaattccgcgtgtagcagtgaaatgcgtagatatgcggaggaacaccgatggcgaaggcaatcccctggacctgtactgacgctcatgcacgaaagcgtggggagcaaacagg

SEQ ID NO: 937 - DNA, 254 bp, Unknown
  Kingdom: Bacteria, Phylum: Proteobacteria, Class: Betaproteobacteria, Order: Burkholderiales, Family: Comamonadaceae, Genus:
atacgtagggtgcaagcgttaatcggaattactgggcgtaaagcgtgcgcaggcggctttgcaagacagatgtgaaatccccgggctcaacctgggaactgcatttgtgactgcatggctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacagg

SEQ ID NO: 938 - DNA, 254 bp, Unknown
  Kingdom: Bacteria, Phylum: Proteobacteria, Class: Betaproteobacteria, Order: Burkholderiales, Family: Comamonadaceae, Genus:
atacgtagggtgcgagcgttaatcggaattactgggcgtaaagcgtgcgcaggcggttatgtaagacagatgtgaaatccccgggctcaacctgggaactgcatttgtgactgcatggctagagtacggtagagggggatggaattccgcgtgtagcagtgaaatgcgtagatatgcggaggaacaccgatggcgaaggcaatcccctggacctgtactgacgctcatgcacgaaagcgtggggagcaaacagg

SEQ ID NO: 939 - DNA, 254 bp, Unknown
  Kingdom: Bacteria, Phylum: Proteobacteria, Class: Betaproteobacteria, Order: Burkholderiales, Family: Comamonadaceae, Genus:
atacgtagggtgcaagcgttaatcggaattactgggcgtaaagcgtgcgcaggcggtgatgtaagacagatgtgaaatccccgggctcaacctgggaactgcatttgtgactgcatcgctggagtacggcagagggggatggaattccgcgtgtagcagtgaaatgcgtagatatgcggaggaacaccgatggcgaaggcaatcccctgggcctgtactgacgctcatgcacgaaagcgtggggagcaaacagg

SEQ ID NO: 940 - DNA, 254 bp, Unknown
  Kingdom: Bacteria, Phylum: Proteobacteria, Class: Betaproteobacteria, Order: Burkholderiales, Family: Comamonadaceae, Genus:
atacgtagggtgcaagcgttaatcggaattactgggcgtaaagcgtgcgcaggcggttatgtaagacaggtgtgaaatccccgggcttaacctgggaactgcatttgtgactgcatagctagagtacggtagagggggatggaattccgcgtgtagcagtgaaatgcgtagatatgcggaggaacaccgatggcgaaggcaatcccctggacctgtactgacgctcatgcacgaaagcgtggggagcaaacagg

SEQ ID NO: 941 - DNA, 254 bp, Unknown
  Kingdom: Bacteria, Phylum: Proteobacteria, Class: Betaproteobacteria, Order: Burkholderiales, Family: Comamonadaceae, Genus:
atacgtagggtgcaagcgttaatcggaattactgggcgtaaagcgtgcgcaggcggttatataagacagatgtgaaatccccgggctcaacctgggaactgcatttgtgactgtatagctagagtacggcagagggggatggaattccgcgtgtagcagtgaaatgcgtagatatgcggaggaacaccgatggcgaaggcaatcccctgggcctgtactgacgctcatgcacgaaagcgtggggagcaaacagg

SEQ ID NO: 942 - DNA, 254 bp, Unknown
  Kingdom: Bacteria, Phylum: Proteobacteria, Class: Betaproteobacteria, Order: Burkholderiales, Family: Comamonadaceae, Genus:
atacgtagggtgcaagcgttaatcggaattactgggcgtaaagcgtgcgcaggcggttttgtaagacagtggtgaaatccccgggctcaacctgggaactgccattgtgactgcaaggctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacagg

SEQ ID NO: 943 - DNA, 251 bp, Unknown
  Kingdom: Bacteria, Phylum: Proteobacteria, Class: Betaproteobacteria, Order: Burkholderiales, Family: Comamonadaceae, Genus:
tacgtagggtgcgagcgttaatcggaattactgggcgtaaagcgtgcgcaggcggtaatgtaagacagatgtgaaatccccgggctcaacctgggaactgcatttgtgactgcattgctggagtgcggcagagggggatggaattccgcgtgtagcagtgaaatgcgtagatatgcggaggaacaccgatggcgaaggcaatcccctgggcctactgacgctcatgcacgaaagcgtggggagcaaacagg

SEQ ID NO: 944 - DNA, 251 bp, Unknown
  Kingdom: Bacteria, Phylum: Proteobacteria, Class: Betaproteobacteria, Order: Burkholderiales, Family: Comamonadaceae, Genus:
tacgtagggtgcaagcgttaatcggaattactgggcgtaaagcgtgcgcaggcggttttgtaagacaggtgtgaaatccccgggcttaacctgggaactgcatttgtgactgcaaggctggagtgcggcagagggggatggaattccgcgtgtagcagtgaaatgcgtagatatgcggaggaacaccgatggcgaaggcaatcccctgggcctactgacgctcatgcacgaaagcgtggggagcaaacagg

SEQ ID NO: 945 - DNA, 251 bp, Unknown
  Kingdom: Bacteria, Phylum: Proteobacteria, Class: Betaproteobacteria, Order: Burkholderiales, Family: Comamonadaceae, Genus:
tacgtagggtgcaagcgttaatcggaattactgggcgtaaagcgtgcgcaggcggtgatgtaagacagatgtgaaatccccgggctcaacctgggaactgcatttgtgactgcatcgctggagtgcggcagagggggatggaattccgcgtgtagcagtgaaatgcgtagatatgcggaggaacaccgatggcgaaggcaatcccctgggcctactgacgctcatgcacgaaagcgtggggagcaaacagg

SEQ ID NO: 946 - DNA, 254 bp, Unknown
  Kingdom: Bacteria, Phylum: Proteobacteria, Class: Betaproteobacteria, Order: Burkholderiales, Family: Comamonadaceae, Genus:
atacgtagggtgcgagcgttaatcggaattactgggcgtaaagcgtgcgcaggcggctttgcaagacagatgtgaaatccccgggctcaacctgggaactgcatttgtgactgcaaggctagagtacggcagagggggatggaattccgcgtgtagcagtgaaatgcgtagatatgcggaggaacaccaatggcgaaggcaatcccctgggcctgtactgacgctcatgcacgaaagcgtggggagcaaacagg

SEQ ID NO: 947 - DNA, 254 bp, Unknown
  Kingdom: Bacteria, Phylum: Proteobacteria, Class: Betaproteobacteria, Order: Burkholderiales, Family: Comamonadaceae, Genus:
atacgtagggtgcgagcgttaatcggaattactgggcgtaaagcgtgcgcaggcggtgatgtaagacagatgtgaaatccccgggctcaacctgggaactgcatttgtgactgcatcgctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacagg

SEQ ID NO: 948 - DNA, 254 bp, Unknown
  Kingdom: Bacteria, Phylum: Proteobacteria, Class: Betaproteobacteria, Order: Burkholderiales, Family: Comamonadaceae, Genus:
atacgtagggtgcaagcgttaatcggaattactgggcgtaaagcgtgcgcaggcggttgtgcaagacaggtgtgaaatccccgggcttaacctgggaactgcacttgtgactgcacagctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacagg

SEQ ID NO: 949 - DNA, 254 bp, Unknown
  Kingdom: Bacteria, Phylum: Proteobacteria, Class: Betaproteobacteria, Order: Burkholderiales, Family: Comamonadaceae, Genus:
atacgtagggtgcaagcgttaatcggaattactgggcgtaaagcgtgcgcaggcggttctataagacagatgtgaaatccccgggctcaacctgggaactgcatttgtgactgtagagctagagtacggtagagggggatggaattccgcgtgtagcagtgaaatgcgtagatatgcggaggaacaccgatggcgaaggcaatcccctggacctgtactgacgctcatgcacgaaagcgtggggagcaaacagg

SEQ ID NO: 950 - DNA, 254 bp, Unknown
  Kingdom: Bacteria, Phylum: Proteobacteria, Class: Betaproteobacteria, Order: Burkholderiales, Family: Comamonadaceae, Genus:
atacgtagggtgcgagcgttaatcggaattactgggcgtaaagcgtgcgcaggcggttttgtaagacagaggtgaaatccccgggctcaacctgggaactgcctttgtgactgcaaggcttgagtgcggcagagggggatggaattccgcgtgtagcagtgaaatgcgtagatatgcggaggaacaccgatggcgaaggcaatcccctgggcctgcactgacgctcatgcacgaaagcgtggggagcaaacagg

SEQ ID NO: 951 - DNA, 254 bp, Unknown
  Kingdom: Bacteria, Phylum: Proteobacteria, Class: Betaproteobacteria, Order: Burkholderiales, Family: Comamonadaceae, Genus:
atacgtagggtgcaagcgttaatcggaattactgggcgtaaagcgtgcgcaggcggttatataagacagttgtgaaatccccgggctcaacctgggaactgcatctgtgactgtatagctagagtacggtagagggggatggaattccgcgtgtagcagtgaaatgcgtagatatgcggaggaacaccgatggcgaaggcaatcccctggacctgtactgacgctcatgcacgaaagcgtggggagcaaacagg

SEQ ID NO: 952 - DNA, 251 bp, Unknown
  Kingdom: Bacteria, Phylum: Proteobacteria, Class: Betaproteobacteria, Order: Burkholderiales, Family: Comamonadaceae, Genus:
tacgtagggtgcaagcgttaatcggaattactgggcgtaaagcgtgcgcaggcggttctataagacagatgtgaaatccccgggctcaacctgggaactgcatttgtgactgtagagctggagtacggtagagggggatggaattccgcgtgtagcagtgaaatgcgtagatatgcggaggaacaccgatggcgaaggcaatcccctggacctactgacgctcatgcacgaaagcgtggggagcaaacagg

SEQ ID NO: 953 - DNA, 254 bp, Unknown
  Kingdom: Bacteria, Phylum: Proteobacteria, Class: Betaproteobacteria, Order: Burkholderiales, Family: Comamonadaceae, Genus:
atacgtagggtgcaagcgttaatcggaattactgggcgtaaagcgtgcgcaggcggttatgtaagacagttgtgaaatccccgggctcaacctgggaattgcatctgtgactgcatagctagagtacggtagagggggatggaattccgcgtgtagcagtgaaatgcgtagatatgcggaggaacaccgatggcgaaggcaatcccctggacctgtactgacgctcatgcacgaaagcgtggggagcaaacagg

SEQ ID NO: 954 - DNA, 254 bp, Unknown
  Kingdom: Bacteria, Phylum: Proteobacteria, Class: Betaproteobacteria, Order: Burkholderiales, Family: Comamonadaceae, Genus:
atacgtagggtgcgagcgttaatcggaattactgggcgtaaagcgtgcgcaggcggtgatgtaagacaggtgtgaaatccccgggcttaacctgggaactgcatttgtgactgcatcgctggagtgcggcagagggggatggaattccgcgtgtagcagtgaaatgcgtagatatgcggaggaacaccgatggcgaaggcaatcccctgggcctgcactgacgctcatgcacgaaagcgtggggagcaaacagg

SEQ ID NO: 955 - DNA, 255 bp, Unknown
  Kingdom: Bacteria, Phylum: Proteobacteria, Class: Betaproteobacteria, Order: Burkholderiales, Family: Oxalobacteraceae, Genus: Massilia
atacgtagggtgcaagcgttaatcggaattactgggcgtaaagcgtgcgcaggcggttttgtaagtctgtcgtgaaatccccgggctcaacctgggaattgcgatggagactgcaaggctagaatctggcagaggggggtagaattccacgtgtagcagtgaaatgcgtagagatgtggaggaacaccgatggcgaaggcagccccctggggtcaagattgacgctcatgcacgaaagcgtggggagcaaacagg

SEQ ID NO: 956 - DNA, 251 bp, Unknown
  Kingdom: Bacteria, Phylum: Proteobacteria, Class: Betaproteobacteria, Order: Burkholderiales, Family: Oxalobacteraceae, Genus: Massilia
tacgtagggtgcaagcgttaatcggaattactgggcgtaaagcgtgcgcaggcggttttgtaagtctgatgtgaaatccccgggctcaacctgggaattgcattggagactgcaaggctggagtctggcagaggggggtagaattccacgtgtagcagtgaaatgcgtagagatgtggaggaacaccgatggcgaaggcagccccctgggtcaactgacgctcatgcacgaaagcgtggggagcaaacagg

SEQ ID NO: 957 - DNA, 254 bp, Unknown
  Kingdom: Bacteria, Phylum: Proteobacteria, Class: Betaproteobacteria, Order: Burkholderiales, Family: Oxalobacteraceae, Genus:
atacgtagggtgcaagcgttaatcggaattactgggcgtaaagcgtgcgcaggcggttttgtaagtctgacgtgaaatccccgggctcaacctgggaattgcgttggagactgcaaggctagaatctggcagaggggggtagaattccacgtgtagcagtgaaatgcgtagagatgtggaggaacaccgatggcgaaggcagccccctgggtcaagattgacgctcatgcacgaaagcgtggggagcaaacagg

SEQ ID NO: 958 - DNA, 254 bp, Unknown
  Kingdom: Bacteria, Phylum: Proteobacteria, Class: Betaproteobacteria, Order: Burkholderiales, Family: Oxalobacteraceae, Genus:
atacgtagggtgcaagcgttaatcggaattactgggcgtaaagcgtgcgcaggcggttgtgcaagacagatgtgaaatccccgggcttaacctgggaattgcatttgtgactgcacggctagagtgtgtcagaggggggtagaattccacgtgtagcagtgaaatgcgtagatatgtggaggaataccgatggcgaaggcagccccctgggataacactgacgctcatgcacgaaagcgtggggagcaaacagg

SEQ ID NO: 959 - DNA, 251 bp, Unknown
  Kingdom: Bacteria, Phylum: Proteobacteria, Class: Betaproteobacteria, Order: Burkholderiales, Family: Oxalobacteraceae, Genus:
tacgtagggtgcaagcgttaatcggaattactgggcgtaaagcgtgcgcaggcggttttgtaagtctgtcgtgaaagccccgggctcaacctgggaattgcgatggagactgcaaggcttgaatctggcagaggggggtagaattccacgtgtagcagtgaaatgcgtagagatgtggaggaacaccgatggcgaaggcagccccctgggtcaattgacgctcatgcacgaaagcgtggggagcaaacagg

SEQ ID NO: 960 - DNA, 254 bp, Unknown
  Kingdom: Bacteria, Phylum: Proteobacteria, Class: Betaproteobacteria, Order: Burkholderiales, Family: Oxalobacteraceae, Genus:
atacgtagggtgcaagcgttaatcggaattactgggcgtaaagcgtgcgcaggcggttttgtaagtctgacgtgaaagccccgggctcaacctgggaattgcgttggagactgcaaggcttgaatctggcagaggggggtagaattccacgtgtagcagtgaaatgcgtagagatgtggaggaacaccgatggcgaaggcagccccctgggtcaagattgacgctcatgcacgaaagcgtggggagcaaacagg

SEQ ID NO: 961 - DNA, 251 bp, Unknown
  Kingdom: Bacteria, Phylum: Proteobacteria, Class: Betaproteobacteria, Order: Burkholderiales, Family: Oxalobacteraceae, Genus:
tacgtagggtgcaagcgttaatcggaattactgggcgtaaagcgtgcgcaggcggttgtgcaagacagatgtgaaatccccgggctcaacctgggaattgcatttgtgactgcacggctagagtgtgtcagaggggggtagaattccacgtgtagcagtgaaatgcgtagagatgtggaggaataccgatggcgaaggcagccccctgggataactgacgctcatgcacgaaagcgtggggagcaaacagg

SEQ ID NO: 962 - DNA, 251 bp, Unknown
  Kingdom: Bacteria, Phylum: Proteobacteria, Class: Betaproteobacteria, Order: Burkholderiales, Family: Oxalobacteraceae, Genus:
tacgtagggtgcgagcgttaatcggaattactgggcgtaaagcgtgcgcaggcggttgtgcaagacagatgtgaaatccccgggctcaacctgggaattgcatttgtgactgtacggctagagtgtgtcagaggggggtagaattccacgtgtagcagtgaaatgcgtagagatgtggaggaataccgatggcgaaggcagccccctgggataactgacgctcatgcacgaaagcgtggggagcaaacagg

SEQ ID NO: 963 - DNA, 254 bp, Unknown
  Kingdom: Bacteria, Phylum: Proteobacteria, Class: Betaproteobacteria, Order: Burkholderiales, Family: Oxalobacteraceae, Genus:
atacgtagggtgcgagcgttaatcggaattactgggcgtaaagcgtgcgcaggcggttttgtaagtctgacgtgaaatccccgggcttaacctgggaattgcgttggagactgcaaggctggagtctggcagaggggggtagaattccacgtgtagcagtgaaatgcgtagagatgtggaggaacaccgatggcgaaggcagccccctgggtcaagactgacgctcatgcacgaaagcgtggggagcaaacagg

SEQ ID NO: 964 - DNA, 251 bp, Unknown
  Kingdom: Bacteria, Phylum: Proteobacteria, Class: Betaproteobacteria, Order: Burkholderiales, Family: Oxalobacteraceae, Genus:
tacgtagggtgcaagcgttaatcggaattactgggcgtaaagcgtgcgcaggcggttttgtaagtttgtcgtgaaatccccgggctcaacctgggaatggcgatgaagactgcaaggctagaatctggcagaggggggtagaattccacgtgtagcagtgaaatgcgtagagatgtggaggaacaccgatggcgaaggcagccccctgggtcaattgacgctcatgcacgaaagcgtggggagcaaacagg

SEQ ID NO: 965 - DNA, 254 bp, Unknown
  Kingdom: Bacteria, Phylum: Proteobacteria, Class: Betaproteobacteria, Order: Burkholderiales, Family: Oxalobacteraceae, Genus:
atacgtagggtgcaagcgttaatcggaattactgggcgtaaagcgtgcgcaggcggtttttcaagacagatgtgaaatccccgggcttaacctgggaatggcatttgtgactggaaggctagagtgtgtcagaggggggtagaattccacgtgtagcagtgaaatgcgtagagatgtggaggaataccgatggcgaaggcagccccctgggataacactgacgctcatgcacgaaagcgtggggagcaaacagg

SEQ ID NO: 966 - DNA, 254 bp, Unknown
  Kingdom: Bacteria, Phylum: Proteobacteria, Class: Betaproteobacteria, Order: Burkholderiales, Family: Oxalobacteraceae, Genus:
atacgtagggtgcaagcgttaatcggaattactgggcgtaaagcgtgcgcaggcggttttgtaagtctgtcgtgaaatccccgggcttaacctgggaattgcgatggagactgcaaggctggagtctggcagaggggggtagaattccacgtgtagcagtgaaatgcgtagagatgtggaggaacaccgatggcgaaggcagccccctgggtcaagactgacgctcatgcacgaaagcgtggggagcaaacagg

SEQ ID NO: 967 - DNA, 254 bp, Unknown
  Kingdom: Bacteria, Phylum: Proteobacteria, Class: Betaproteobacteria, Order: Burkholderiales, Family: Oxalobacteraceae, Genus:
atacgtagggtgcaagcgttaatcggaattactgggcgtaaagcgtgcgcaggcggttttgtaagtctgttgtgaaatccccgggctcaacctgggaatggcaatggagactgcaaggctagagtttggcagaggggggtagaattccacgtgtagcagtgaaatgcgtagatatgtggaggaacaccgatggcgaaggcagccccctgggtcaaaactgacgctcatgcacgaaagcgtggggagcaaacagg

SEQ ID NO: 968 - DNA, 251 bp, Unknown
  Kingdom: Bacteria, Phylum: Proteobacteria, Class: Betaproteobacteria, Order: Burkholderiales, Family: Oxalobacteraceae, Genus:
tacgtagggtgcaagcgttaatcggaattactgggcgtaaagcgtgcgcaggcggttgtgcaagacagatgtgaaatccccgggcttaacctgggaactgcatttgtgactgcacggctagagtgtgtcagaggggggtagaattccacgtgtagcagtgaaatgcgtagatatgtggaggaataccgatggcgaaggcagccccctgggataactgacgctcatgcacgaaagcgtggggagcaaacagg

SEQ ID NO: 969 - DNA, 254 bp, Unknown
  Kingdom: Bacteria, Phylum: Proteobacteria, Class: Betaproteobacteria, Order: Burkholderiales, Family: Oxalobacteraceae, Genus:
atacgtagggtgcaagcgttaatcggaattactgggcgtaaagcgtgcgcaggcggttttgtaagtctgtcgtgaaatccccgggctcaacctgggaattgcgatggagactgcaaggctagagtttggcagaggggggtagaattccacgtgtagcagtgaaatgcgtagatatgtggaggaacaccgatggcgaaggcagccccctgggtcaaaactgacgctcatgcacgaaagcgtggggagcaaacagg

SEQ ID NO: 970 - DNA, 254 bp, Unknown
  Kingdom: Bacteria, Phylum: Proteobacteria, Class: Betaproteobacteria, Order: Burkholderiales, Family: Oxalobacteraceae, Genus:
atacgtagggtgcaagcgttaatcggaattactgggcgtaaagcgtgcgcaggcggtttggtaagacagatgtgaaatccccgggcttaacctgggaattgcattcgtgactgcccggctagagtttggcagaggggggtagaattccacgtgtagcagcgaaatgcgtagatatgtggaggaataccgatggcgaaggcagccccctgggtcaagactgacgctcatgcacgaaagcgtggggagcaaacagg

SEQ ID NO: 971 - DNA, 251 bp, Unknown
  Kingdom: Bacteria, Phylum: Proteobacteria, Class: Betaproteobacteria, Order: Burkholderiales, Family: Oxalobacteraceae, Genus:
tacgtagggtgcaagcgttaatcggaattactgggcgtaaagcgtgcgcaggcggttttgtaagtctgtcgtgaaatccccgggctcaacctgggaatggcgatggagactgcaaggctagagtttggcagaggggggtagaattccacgtgtagcagtgaaatgcgtagatatgtggaggaacaccgatggcgaaggcagccccctgggtcaactgacgctcatgcacgaaagcgtggggagcaaacagg

SEQ ID NO: 972 - DNA, 254 bp, Unknown
  Kingdom: Bacteria, Phylum: Proteobacteria, Class: Betaproteobacteria, Order: Burkholderiales, Family: Oxalobacteraceae, Genus:
atacgtagggtgcaagcgttaatcggaattactgggcgtaaagcgtgcgcaggcggttttgtaagtctgtcgtgaaagccccgggctcaacctgggaattgcgatggagactgcaaggcttgaatctggcagaggggggtagaattccacgtgtagcagtgaaatgcgtagagatgtggaggaacaccgatggcgaaggcagccccctgggtcaagattgacgctcatgcacgaaagcgtggggagcaaacagg

SEQ ID NO: 973 - DNA, 254 bp, Unknown
  Kingdom: Bacteria, Phylum: Proteobacteria, Class: Betaproteobacteria, Order: Burkholderiales, Family: Oxalobacteraceae, Genus:
atacgtagggtgcaagcgttaatcggaattactgggcgtaaagcgtgcgcaggcggttttgtaagtctgtcgtgaaatccccgggctcaacctgggaatggcgatggagactgcaaggctagaatctggcagaggggggtagaattccacgtgtagcagtgaaatgcgtagagatgtggaggaacaccgatggcgaaggcagccccctgggtcaagattgacgctcatgcacgaaagcgtggggagcaaacagg

SEQ ID NO: 974 - DNA, 251 bp, Unknown
  Kingdom: Bacteria, Phylum: Proteobacteria, Class: Betaproteobacteria, Order: Burkholderiales, Family: Oxalobacteraceae, Genus:
tacgtagggtgcaagcgttaatcggaattactgggcgtaaagcgtgcgcaggcggttttgtaagtctgtcgtgaaagccccgggcttaacctgggaattgcgatggagactgcaaggcttgaatctggcagaggggggtagaattccacgtgtagcagtgaaatgcgtagagatgtggaggaacaccgatggcgaaggcagccccctgggtcaattgacgctcatgcacgaaagcgtggggagcaaacagg

SEQ ID NO: 975 - DNA, 254 bp, Unknown
  Kingdom: Bacteria, Phylum: Proteobacteria, Class: Betaproteobacteria, Order: Burkholderiales, Family: Oxalobacteraceae, Genus:
atacgtagggtgcaagcgttaatcggaattactgggcgtaaagcgtgcgcaggcggttttgtaagtctgtcgtgaaatccccgggctcaacctgggaattgcgatggagactgcaaggctagaatctggcagaggggggtagaattccacgtgtagcagtgaaatgcgtagagatgtggaggaacaccgatggcgaaggcagccccctgggtcaagattgacgctcatgcgcgaaagcgtggggagcaaacagg

SEQ ID NO: 976 - DNA, 254 bp, Unknown
  Kingdom: Bacteria, Phylum: Proteobacteria, Class: Betaproteobacteria, Order: Burkholderiales, Family: Oxalobacteraceae, Genus:
atacgtagggtgcaagcgttaatcggaattactgggcgtaaagcgtgcgcaggcggttttgtaagtctgtcgtgaaagccccgggctcaacctgggaattgcgatggagactgcaaggcttgaatctggcagaggggggtagaattccacgtgtagcagtgaaatgcgtagagatgtggaggaacaccgatggcgaaggcagccccctgggttaagattgacgctcatgcacgaaagcgtggggagcaaacagg

SEQ ID NO: 977 - DNA, 251 bp, Unknown
  Kingdom: Bacteria, Phylum: Proteobacteria, Class: Betaproteobacteria, Order: Burkholderiales, Family: Oxalobacteraceae, Genus:
tacgtagggtgcgagcgttaatcggaattactgggcgtaaagcgtgcgcaggcggttttgtaagtctgacgtgaaatccccgggctcaacctgggaattgcgttggagactgcaaggctggagtctggcagaggggggtagaattccacgtgtagcagtgaaatgcgtagagatgtggaggaacaccgatggcgaaggcagccccctgggtcaactgacgctcatgcacgaaagcgtggggagcaaacagg

SEQ ID NO: 978 - DNA, 254 bp, Unknown
  Kingdom: Bacteria, Phylum: Proteobacteria, Class: Betaproteobacteria, Order: Burkholderiales, Family: Oxalobacteraceae, Genus:
atacgtagggtgcaagcgttaatcggaattactgggcgtaaagcgtgcgcaggcggttttgtaagtctgacgtgaaatccccgggcttaacctgggaattgcgttggagactgcaaggctggagtctggcagaggggggtagaattccacgtgtagcagtgaaatgcgtagagatgtggaggaacaccgatggcgaaggcagccccctgggtcaagactgacgctcatgcacgaaagcgtggggagcaaacagg

SEQ ID NO: 979 - DNA, 254 bp, Unknown
  Kingdom: Bacteria, Phylum: Proteobacteria, Class: Betaproteobacteria, Order: Burkholderiales, Family: Oxalobacteraceae, Genus:
atacgtagggtgcaagcgttaatcggaattactgggcgtaaagcgtgcgcaggcggttgtgcaagaccgatgtgaaatccccgggcttaacctgggaatggcattggtgactgcacggctagagtgtgtcagaggggggtagaattccacgtgtagcagtgaaatgcgtagagatgtggaggaataccgatggcgaaggcagccccctgggataacactgacgctcatgcacgaaagcgtggggagcaaacagg

SEQ ID NO: 980 - DNA, 251 bp, Unknown
  Kingdom: Bacteria, Phylum: Proteobacteria, Class: Betaproteobacteria, Order: Burkholderiales, Family: Oxalobacteraceae, Genus:
tacgtagggtgcaagcgttaatcggaattactgggcgtaaagcgtgcgcaggcggttttgtaagtttgtcgtgaaatccccgggctcaacctgggaatggcgatgaagactgcaaggctagagtttggcagaggggggtagaattccacgtgtagcagtgaaatgcgtagatatgtggaggaacaccgatggcgaaggcagccccctgggtcaactgacgctcatgcacgaaagcgtggggagcaaacagg

SEQ ID NO: 981 - DNA, 254 bp, Unknown
  Kingdom: Bacteria, Phylum: Proteobacteria, Class: Betaproteobacteria, Order: Burkholderiales, Family: Oxalobacteraceae, Genus:
atacgtagggtgcaagcgttaatcggaattactgggcgtaaagcgtgcgcaggcggttttgtaagtctgtcgtgaaatccccgggctcaacctgggaatggcgatggagactgcaaggctagagtttggcagaggggggtagaattccacgtgtagcagtgaaatgcgtagatatgtggaggaacaccgatggcgaaggcagccccctgggtcaaaactgacgctcatgcacgaaagcgtggggagcaaacagg

SEQ ID NO: 982 - DNA, 254 bp, Unknown
  Kingdom: Bacteria, Phylum: Proteobacteria, Class: Betaproteobacteria, Order: Burkholderiales, Family: Oxalobacteraceae, Genus:
atacgtagggtgcaagcgttaatcggaattactgggcgtaaagcgtgcgcaggcggttttgtaagtctgtcgtgaaatccccgggctcaacctgggaattgcgatggagactgcaaggctagaatctggcagaggggggtagaattccacgtgtagcagtgaaatgcgtagagatgtggaggaacaccgatggcgaaggcagccccctgggtcaagattgacgctcatgcacgaaagcgtggggagcaaacagg

SEQ ID NO: 983 - DNA, 254 bp, Unknown
  Kingdom: Bacteria, Phylum: Proteobacteria, Class: Betaproteobacteria, Order: Burkholderiales, Family: Oxalobacteraceae, Genus:
atacgtagggtgcaagcgttaatcggaattactgggcgtaaagcgtgcgcaggcggttttgtaagtctgtcgtgaaatccccgggcttaacctgggaatggcgatggagactgcaaggctagagtttggcagaggggggtagaattccacgtgtagcagtgaaatgcgtagagatgtggaggaacaccgatggcgaaggcagccccctgggtcaagactgacgctcatgcacgaaagcgtggggagcaaacagg

SEQ ID NO: 984 - DNA, 251 bp, Unknown
  Kingdom: Bacteria, Phylum: Proteobacteria, Class: Betaproteobacteria, Order: Burkholderiales, Family: Oxalobacteraceae, Genus:
tacgtagggtgcaagcgttaatcggaattactgggcgtaaagcgtgcgcaggcggtttcgtaagtctgatgtgaaatccccgggcttaacctgggaattgcattggagactgcgaggctagaatctggcagaggggggtagaattccacgtgtagcagtgaaatgcgtagagatgtggaggaacaccgatggcgaaggcagccccctgggtcaattgacgctcatgcacgaaagcgtggggagcaaacagg

SEQ ID NO: 985 - DNA, 254 bp, Unknown
  Kingdom: Bacteria, Phylum: Proteobacteria, Class: Betaproteobacteria, Order: Burkholderiales, Family: Oxalobacteraceae, Genus:
atacgtagggtgcaagcgttaatcggaattactgggcgtaaagcgtgcgcaggcggttttgtaagtctgttgtgaaatccccgggcttaacctgggaatggcaatggagactgcaaggctagagtttggcagaggggggtagaattccacgtgtagcagtgaaatgcgtagagatgtggaggaacaccgatggcgaaggcagccccctgggtcaagactgacgctcatgcacgaaagcgtggggagcaaacagg

SEQ ID NO: 986 - DNA, 254 bp, Unknown
  Kingdom: Bacteria, Phylum: Proteobacteria, Class: Betaproteobacteria, Order: Burkholderiales, Family: Oxalobacteraceae, Genus:
atacgtagggtgcaagcgttaatcggaattactgggcgtaaagcgtgcgcaggcggttgtgcaagacagatgtgaaatccccgggcttaacctgggaattgcatttgtgactgcacggctagagtgtgtcagaggggggtagaattccacgtgtagcagtgaaatgcgtagagatgtggaggaataccgatggcgaaggcagccccctgggataacactgacgctcatgcacgaaagcgtggggagcaaacagg

SEQ ID NO: 987 - DNA, 254 bp, Unknown
  Kingdom: Bacteria, Phylum: Proteobacteria, Class: Betaproteobacteria, Order: Burkholderiales, Family: Oxalobacteraceae, Genus:
atacgtagggtgcaagcgttaatcggaattactgggcgtaaagcgtgcgcaggcggttttgtaagtctgacgtgaaatccccgagcttaacttgggaattgcgttggagactgcaaggctggagtctggcagaggggggtagaattccacgtgtagcagtgaaatgcgtagagatgtggaggaacaccgatggcgaaggcagccccctgggtcaagactgacgctcatgcacgaaagcgtggggagcaaacagg

SEQ ID NO: 988 - DNA, 251 bp, Unknown
  Kingdom: Bacteria, Phylum: Proteobacteria, Class: Betaproteobacteria, Order: Burkholderiales, Family: Oxalobacteraceae, Genus:
tacgtagggtgcaagcgttaatcggaattactgggcgtaaagcgtgcgcaggcggttttgtaagtctgtcgtgaaatccccgggctcaacctgggaattgcgatggagactgcaaggctggagtctggcagaggggggtagaattccacgtgtagcagtgaaatgcgtagagatgtggaggaacaccgatggcgaaggcagccccctgggtcaactgacgctcatgcacgaaagcgtggggagcaaacagg

SEQ ID NO: 989 - DNA, 251 bp, Unknown
  Kingdom: Bacteria, Phylum: Proteobacteria, Class: Betaproteobacteria, Order: Burkholderiales, Family: Oxalobacteraceae, Genus:
tacgtagggtgcaagcgttaatcggaattactgggcgtaaagcgtgcgcaggcggttgtgcaagacagatgtgaaatccccgggcttaacctgggaattgcatttgtgactgcacggctagagtgtgtcagaggggggtagaattccacgtgtagcagtgaaatgcgtagatatgtggaggaataccgatggcgaaggcagccccctgggataactgacgctcatgcacgaaagcgtggggagcaaacagg

SEQ ID NO: 990 - DNA, 254 bp, Unknown
  Kingdom: Bacteria, Phylum: Proteobacteria, Class: Betaproteobacteria, Order: Burkholderiales, Family: Oxalobacteraceae, Genus:
atacgtagggtgcaagcgttaatcggaattactgggcgtaaagcgtgcgcaggcggttttgtaagtctgatgtgaaatccccgggctcaacctgggaattgcattggagactgcaaggctagaatctggcagaggggggtagaattccacgtgtagcagtgaaatgcgtagatatgtggaggaacaccgatggcgaaggcagccccctgggtcaagattgacgctcatgcacgaaagcgtggggagcaaacagg

SEQ ID NO: 991 - DNA, 254 bp, Unknown
  Kingdom: Bacteria, Phylum: Proteobacteria, Class: Betaproteobacteria, Order: Burkholderiales, Family: Oxalobacteraceae, Genus:
atacgtagggtgcaagcgttaatcggaattactgggcgtaaagcgtgcgcaggcggttgtgcaagacagatgtgaaatccccgggcttaacctgggaactgcatttgtgactgcacggctagagtgtgtcagaggggggtagaattccacgtgtagcagtgaaatgcgtagatatgtggaggaataccgatggcgaaggcagccccctgggataacactgacgctcatgcacgaaagcgtggggagcaaacagg

SEQ ID NO: 992 - DNA, 254 bp, Unknown
  Kingdom: Bacteria, Phylum: Proteobacteria, Class: Betaproteobacteria, Order: Burkholderiales, Family: Oxalobacteraceae, Genus:
atacgtagggtgcaagcgttaatcggaattactgggcgtaaagcgtgcgcaggcggttttgtaagtttgtcgtgaaagccccgggctcaacctgggaattgcgatgaagactgcaaggcttgaatctggcagaggggggtagaattccacgtgtagcagtgaaatgcgtagagatgtggaggaacaccgatggcgaaggcagccccctgggtcaagattgacgctcatgcacgaaagcgtggggagcaaacagg

SEQ ID NO: 993 - DNA, 254 bp, Unknown
  Kingdom: Bacteria, Phylum: Proteobacteria, Class: Betaproteobacteria, Order: Burkholderiales, Family: Oxalobacteraceae, Genus:
atacgtagggtgcgagcgttaatcggaattactgggcgtaaagcgtgcgcaggcggttttgtaagtctgacgtgaaatccccgggctcaacctgggaattgcgttggagactgcaaggctggagtctggcagaggggggtagaattccacgtgtagcagtgaaatgcgtagagatgtggaggaacaccgatggcgaaggcagccccctgggtcaagactgacgctcatgcacgaaagcgtggggagcaaacagg

SEQ ID NO: 994 - DNA, 251 bp, Unknown
  Kingdom: Bacteria, Phylum: Proteobacteria, Class: Betaproteobacteria, Order: Burkholderiales, Family: Oxalobacteraceae, Genus:
tacgtagggtgcaagcgttaatcggaattactgggcgtaaagcgtgcgcaggcggttgtgcaagacagatgtgaaatccccgggctcaacctgggaattgcatttgtgactgcacggctagagtgtgtcagaggggggtagaattccacgtgtagcagtgaaatgcgtagatatgtggaggaataccgatggcgaaggcagccccctgggataactgacgctcatgcacgaaagcgtggggagcaaacagg

SEQ ID NO: 995 - DNA, 254 bp, Unknown
  Kingdom: Bacteria, Phylum: Proteobacteria, Class: Betaproteobacteria, Order: Burkholderiales, Family: Oxalobacteraceae, Genus:
atacgtagggtgcaagcgttaatcggaattactgggcgtaaagcgtgcgcaggcggttttgtaagtctgatgtgaaatccccgggctcaacctgggaattgcattggagactgcaaggctagaatctggcagaggggggtagaattccacgtgtagcagtgaaatgcgtagagatgtggaggaacaccgatggcgaaggcagccccctgggtcaagattgacgctcatgcacgaaagcgtggggagcaaacagg

SEQ ID NO: 996 - DNA, 251 bp, Unknown
  Kingdom: Bacteria, Phylum: Proteobacteria, Class: Betaproteobacteria, Order: Burkholderiales, Family: Oxalobacteraceae, Genus:
tacgtagggtgcaagcgttaatcggaattactgggcgtaaagcgtgcgcaggcggttttgtaagactgtcgtgaaatccccgggcttaacctgggaatggcgatggtgactgcaaggctagagtttggcagaggggggtagaattccacgtgtagcagtgaaatgcgtagagatgtggaggaacaccgatggcgaaggcagccccctgggtcaactgacgctcatgcacgaaagcgtggggagcaaacagg

SEQ ID NO: 997 - DNA, 254 bp, Unknown
  Kingdom: Bacteria, Phylum: Proteobacteria, Class: Betaproteobacteria, Order: Burkholderiales, Family: Oxalobacteraceae, Genus:
atacgtagggtgcaagcgttaatcggaattactgggcgtaaagcgtgcgcaggcggttttgtaagtctgtcgtgaaagccccgggcttaacctgggaattgcgatggagactgcaaggcttgaatctggcagaggggggtagaattccacgtgtagcagtgaaatgcgtagagatgtggaggaacaccgatggcgaaggcagccccctgggtcaagattgacgctcatgcacgaaagcgtggggagcaaacagg

SEQ ID NO: 998 - DNA, 251 bp, Unknown
  Kingdom: Bacteria, Phylum: Proteobacteria, Class: Betaproteobacteria, Order: Burkholderiales, Family: Oxalobacteraceae, Genus:
tacgtagggtgcaagcgttaatcggaattactgggcgtaaagcgtgcgcaggcggttttgtaagtctgtcgtgaaatccccgggcttaacctgggaatggcgatggagactgcaaggctggagtttggcagaggggggtagaattccacgtgtagcagtgaaatgcgtagagatgtggaggaacaccgatggcgaaggcagccccctgggtcaactgacgctcatgcacgaaagcgtggggagcaaacagg

SEQ ID NO: 999 - DNA, 254 bp, Unknown
  Kingdom: Bacteria, Phylum: Proteobacteria, Class: Betaproteobacteria, Order: Burkholderiales, Family: Oxalobacteraceae, Genus:
atacgtagggtgcaagcgttaatcggaattactgggcgtaaagcgtgcgcaggcggttttgtaagtttgtcgtgaaatccccgggctcaacctgggaatggcgatgaagactgcaaggctagagtttggcagaggggggtagaattccacgtgtagcagtgaaatgcgtagatatgtggaggaacaccgatggcgaaggcagccccctgggtcaaaactgacgctcatgcacgaaagcgtggggagcaaacagg

SEQ ID NO: 1000 - DNA, 251 bp, Unknown
  Kingdom: Bacteria, Phylum: Proteobacteria, Class: Betaproteobacteria, Order: Burkholderiales, Family: Oxalobacteraceae, Genus:
tacgtagggtgcaagcgttaatcggaattactgggcgtaaagcgtgcgcaggcggttttgtaagtctgacgtgaaatccccgggcttaacctgggaatggcgttggagactgcaaggctggaatctggcagaggggggtagaattccacgtgtagcagtgaaatgcgtagagatgtggaggaacaccgatggcgaaggcagccccctgggctaattgacgctcatgcacgaaagcgtggggagcaaacagg

SEQ ID NO: 1001 - DNA, 254 bp, Unknown
  Kingdom: Bacteria, Phylum: Proteobacteria, Class: Betaproteobacteria, Order: Burkholderiales, Family: Oxalobacteraceae, Genus:
atacgtagggtgcaagcgttaatcggaattactgggcgtaaagcgtgcgcaggcggttttgtaagtttgtcgtgaaatccccgggctcaacctgggaatggcgatgaagactgcaaggctagaatctggcagaggggggtagaattccacgtgtagcagtgaaatgcgtagagatgtggaggaacaccgatggcgaaggcagccccctgggtcaagattgacgctcatgcacgaaagcgtggggagcaaacagg

SEQ ID NO: 1002 - DNA, 254 bp, Unknown
  Kingdom: Bacteria, Phylum: Proteobacteria, Class: Betaproteobacteria, Order: Burkholderiales, Family: Oxalobacteraceae, Genus:
atacgtagggtgcaagcgttaatcggaattactgggcgtaaagcgtgcgcaggcggttttgtaagtctgttgtgaaatccccgggctcaacctgggaatggcaatggagactgcaaggctagagtttggcagaggggggtagaattccacgtgtagcagtgaaatgcgtagagatgtggaggaacaccgatggcgaaggcagccccctgggtcaagactgacgctcatgcacgaaagcgtggggagcaaacagg

SEQ ID NO: 1003 - DNA, 251 bp, Unknown
  Kingdom: Bacteria, Phylum: Proteobacteria, Class: Betaproteobacteria, Order: Burkholderiales, Family: Oxalobacteraceae, Genus:
tacgtagggtgcaagcgttaatcggaattactgggcgtaaagcgtgcgcaggcggttttgtaagactgtcgtgaaatccccgggctcaacctgggaatggcgatggtgactgcaaggctagagtttggcagaggggggtagaattccacgtgtagcagtgaaatgcgtagatatgtggaggaacaccgatggcgaaggcagccccctgggtcaactgacgctcatgcacgaaagcgtggggagcaaacagg

SEQ ID NO: 1004 - DNA, 254 bp, Unknown
  Kingdom: Bacteria, Phylum: Proteobacteria, Class: Betaproteobacteria, Order: Burkholderiales, Family: Oxalobacteraceae, Genus:
atacgtagggtgcaagcgttaatcggaattactgggcgtaaagcgtgcgcaggcggttgtgtaagacagatgtgaaatccccgggctcaacctgggaattgcatttgtgactgcacggctagagtgtgtcagaggggggtagaattccacgtgtagcagtgaaatgcgtagatatgtggaggaataccgatggcgaaggcagccccctgggataacactgacgctcatgcacgaaagcgtggggagcaaacagg

SEQ ID NO: 1005 - DNA, 254 bp, Unknown
  Kingdom: Bacteria, Phylum: Proteobacteria, Class: Betaproteobacteria, Order: Burkholderiales, Family: Oxalobacteraceae, Genus:
atacgtagggtgcaagcgttaatcggaattactgggcgtaaagcgtgcgcaggcggttgtgtaagtcagatgtgaaatccccgggctcaacctgggaattgcatttgagactgcacggctagagtgtgtcagaggggggtagaattccacgtgtagcagtgaaatgcgtagatatgtggaggaataccgatggcgaaggcagccccctgggataacactgacgctcatgcacgaaagcgtggggagcaaacagg

SEQ ID NO: 1006 - DNA, 254 bp, Unknown
  Kingdom: Bacteria, Phylum: Proteobacteria, Class: Betaproteobacteria, Order: Burkholderiales, Family: Oxalobacteraceae, Genus:
atacgtagggtgcaagcgttaatcggaattactgggcgtaaagcgtgcgcaggcggttttgtaagtctgacgtgaaatccccgggctcaacctgggaattgcgttggagactgcaaggctggagtctggcagaggggggtagaattccacgtgtagcagtgaaatgcgtagagatgtggaggaacaccgatggcgaaggcagccccctgggtcaagactgacgctcatgcacgaaagcgtggggagcaaacagg

SEQ ID NO: 1007 - DNA, 254 bp, Unknown
  Kingdom: Bacteria, Phylum: Proteobacteria, Class: Betaproteobacteria, Order: Burkholderiales, Family: Oxalobacteraceae, Genus:
atacgtagggtgcaagcgttaatcggaattactgggcgtaaagcgtgcgcaggcggttttgtaagtctgacgtgaaagccccgggcttaacctgggaattgcgttggagactgcaaggcttgaatctggcagaggggggtagaattccacgtgtagcagtgaaatgcgtagagatgtggaggaacaccgatggcgaaggcagccccctgggtcaagattgacgctcatgcacgaaagcgtggggagcaaacagg

SEQ ID NO: 1008 - DNA, 254 bp, Unknown
  Kingdom: Bacteria, Phylum: Proteobacteria, Class: Betaproteobacteria, Order: Burkholderiales, Family: Oxalobacteraceae, Genus:
atacgtagggtgcaagcgttaatcggaattactgggcgtaaagcgtgcgcaggcggttatgtaagacagatgtgaaatgcccgggctcaacctgggaactgcatttgtgactgcatggctagagtgtgtcagaggggggtagaattccacgtgtagcagtgaaatgcgtagatatgtggaggaataccgatggcgaaggcagccccctgggataacactgacgctcatgcacgaaagcgtggggagcaaacagg

SEQ ID NO: 1009 - DNA, 254 bp, Unknown
  Kingdom: Bacteria, Phylum: Proteobacteria, Class: Betaproteobacteria, Order: Burkholderiales, Family: Oxalobacteraceae, Genus:
atacgtagggtgcaagcgttaatcggaattactgggcgtaaagcgtgcgcaggcggttttgtaagactgtcgtgaaatccccgggctcaacctgggaatggcgatggtgactgcaaggctagagtttggcagaggggggtagaattccacgtgtagcagtgaaatgcgtagatatgtggaggaacaccgatggcgaaggcagccccctgggtcaaaactgacgctcatgcacgaaagcgtggggagcaaacagg

SEQ ID NO: 1010 - DNA, 254 bp, Unknown
  Kingdom: Bacteria, Phylum: Proteobacteria, Class: Betaproteobacteria, Order: Burkholderiales, Family: Oxalobacteraceae, Genus:
atacgtagggtgcaagcgttaatcggaattactgggcgtaaagcgtgcgcaggcggttgtgcaagacagatgtgaaatccccgggctcaacctgggaattgcatttgtgactgtacggctagagtgtgtcagaggggggtagaattccacgtgtagcagtgaaatgcgtagagatgtggaggaataccgatggcgaaggcagccccctgggataacactgacgctcatgcacgaaagcgtggggagcaaacagg

SEQ ID NO: 1011 - DNA, 251 bp, Unknown
  Kingdom: Bacteria, Phylum: Proteobacteria, Class: Betaproteobacteria, Order: Burkholderiales, Family: Oxalobacteraceae, Genus:
tacgtagggtgcaagcgttaatcggaattactgggcgtaaagcgtgcgcaggcggttttgtaagtctgacgtgaaatccccgggcttaacctgggaattgcgttggagactgcaaggctggagtctggcagaggggggtagaattccacgtgtagcagtgaaatgcgtagagatgtggaggaacaccgatggcgaaggcagccccctgggtcaactgacgctcatgcacgaaagcgtggggagcaaacagg

SEQ ID NO: 1012 - DNA, 251 bp, Unknown
  Kingdom: Bacteria, Phylum: Proteobacteria, Class: Betaproteobacteria, Order: Burkholderiales, Family: Oxalobacteraceae, Genus:
tacgtagggtgcaagcgttaatcggaattactgggcgtaaagcgtgcgcaggcggttttgtaagtctgacgtgaaatccccgggctcaacctgggaattgcgttggagactgcaaggctggagtctggcagaggggggtagaattccacgtgtagcagtgaaatgcgtagagatgtggaggaacaccgatggcgaaggcagccccctgggtcaactgacgctcatgcacgaaagcgtggggagcaaacagg

SEQ ID NO: 1013 - DNA, 251 bp, Unknown
  Kingdom: Bacteria, Phylum: Proteobacteria, Class: Betaproteobacteria, Order: Burkholderiales, Family: Oxalobacteraceae, Genus:
tacgtagggtgcgagcgttaatcggaattactgggcgtaaagcgtgcgcaggcggttgtgcaagacagatgtgaaatccccgggctcaacctgggaattgcatttgtgactgcacggctagagtgtgtcagaggggggtagaattccacgtgtagcagtgaaatgcgtagagatgtggaggaataccgatggcgaaggcagccccctgggataactgacgctcatgcacgaaagcgtggggagcaaacagg

SEQ ID NO: 1014 - DNA, 251 bp, Unknown
  Kingdom: Bacteria, Phylum: Proteobacteria, Class: Betaproteobacteria, Order: Burkholderiales, Family: Oxalobacteraceae, Genus:
tacgtagggtgcaagcgttaatcggaattactgggcgtaaagcgtgcgcaggcggttttgtaagtctgtcgtgaaatccccgggcttaacctgggaatggcgatggagactgcaaggctagagtttggcagaggggggtagaattccacgtgtagcagtgaaatgcgtagagatgtggaggaacaccgatggcgaaggcagccccctgggtcaactgacgctcatgcacgaaagcgtggggagcaaacagg

SEQ ID NO: 1015 - DNA, 254 bp, Unknown
  Kingdom: Bacteria, Phylum: Proteobacteria, Class: Betaproteobacteria, Order: Methylophilales, Family: Methylophilaceae, Genus:
atacgtagggtgcgagcgttaatcggaattactgggcgtaaagcgagcgcaggcggttctgcaagtcagatgtgaaatccccgggctcaacctgggaactgcgtttgaaactacagagctagagtataggagagggaggtagaattccacgtgtagcagtgaaatgcgtagagatgtggaggaataccgatggcgaaggcagcctcctggcctaatactgacgctcatgctcgaaagcgtggggagcaaacagg

SEQ ID NO: 1016 - DNA, 254 bp, Unknown
  Kingdom: Bacteria, Phylum: Proteobacteria, Class: Betaproteobacteria, Order: Methylophilales, Family: Methylophilaceae, Genus:
atacgtagggtgcgagcgttaatcggaattactgggcgtaaagcgtgcgcaggctgttctgtaagtcagatgtgaaacccccgagctcaacttgggaactgcgtttgaaactacaggactagaatatgtcagaggggggtagaattccacgtgtagcagtgaaatgcgtagagatgtggaggaataccaatggcgaaggcagccccctgggataatattgacgctcatgcacgaaagcgtggggagcaaacagg

SEQ ID NO: 1017 - DNA, 254 bp, Unknown
  Kingdom: Bacteria, Phylum: Proteobacteria, Class: Betaproteobacteria, Order: Methylophilales, Family: Methylophilaceae, Genus:
atacgtagggtgcgagcgttaatcggaattactgggcgtaaagcgtgcgcaggcggctttgtaagtcagatgtgaaatccccgagctcaacttgggaactgcgtttgaaactacaaggctagaatatgtcagaggggggtagaattccacgtgtagcagtgaaatgcgtagagatgtggaggaataccaatggcgaaggcagccccctgggataatattgacgctcatgcacgaaagcgtggggagcaaacagg

SEQ ID NO: 1018 - DNA, 254 bp, Unknown
  Kingdom: Bacteria, Phylum: Proteobacteria, Class: Betaproteobacteria, Order: Methylophilales, Family: Methylophilaceae, Genus:
atacgtagggtgcgagcgttaatcggaattactgggcgtaaagcgtgcgcaggcggcctgataagtcagatgtgaaatccccgagctcaacttgggaactgcgtttgaaactatcaagctagaatatgtcagaggggggtagaattccacgtgtagcagtgaaatgcgtagagatgtggaggaataccaatggcgaaggcagccccctgggataatattgacgctcatgcacgaaagcgtggggagcaaacagg

SEQ ID NO: 1019 - DNA, 254 bp, Unknown
  Kingdom: Bacteria, Phylum: Proteobacteria, Class: Betaproteobacteria, Order: Methylophilales, Family: Methylophilaceae, Genus:
atacgtagggtgcgagcgttaatcggaattactgggcgtaaagcgtgcgcaggcggttttgtaagtcagatgtgaaatccccgggctcaacctgggaactgcgtttgaaactacaaggctagagtatggcagaggggggtagaattccacgtgtagcagtgaaatgcgtagagatgtggaggaataccaatggcgaaggcagccccctgggtcaatactgacgctcatgcacgaaagcgtggggagcaaacagg

SEQ ID NO: 1020 - DNA, 254 bp, Unknown
  Kingdom: Bacteria, Phylum: Proteobacteria, Class: Betaproteobacteria, Order: Methylophilales, Family: Methylophilaceae, Genus:
atacgtagggtgcgagcgttaatcggaattactgggcgtaaagcgtgcgcaggcggttcgataagtctgatgtgaaatccccgggctcaacctgggaactgcgttggaaactgtcgggctagagtgtagaagaggggggtagaattccacgtgtagcagtgaaatgcgtagagatgtggaggaataccgatggcgaaggcagccccctgggctaacactgacgctcatgcacgaaagcgtggggagcaaacagg

SEQ ID NO: 1021 - DNA, 254 bp, Unknown
  Kingdom: Bacteria, Phylum: Proteobacteria, Class: Betaproteobacteria, Order: Methylophilales, Family: Methylophilaceae, Genus:
atacgtagggtgcgagcgttaatcggaattactgggcgtaaagcgtgcgcaggctgttttgtaagtcagatgtgaaatccccgagctcaacttgggaactgcgtttgaaactacaagactagaatatgtcagaggggggtagaattccacgtgtagcagtgaaatgcgtagagatgtggaggaataccaatggcgaaggcagccccctgggataatattgacgctcatgcacgaaagcgtggggagcaaacagg

SEQ ID NO: 1022 - DNA, 254 bp, Unknown
  Kingdom: Bacteria, Phylum: Proteobacteria, Class: Betaproteobacteria, Order: Methylophilales, Family: Methylophilaceae, Genus:
atacgtagggtgcgagcgttaatcggaattactgggcgtaaagcgtgcgcaggctgttttgtaagtcagatgtgaaatccccgagctcaacttgggaactgcgtttgaaactacaagactagaatatgtcagaggggggtagaattccacgtgtagcagtgaaatgcgtagagatgtggaggaatatcaatggcgaaggcagccccctgggataatattgacgctcatgcacgaaagcgtggggagcaaacagg

SEQ ID NO: 1023 - DNA, 251 bp, Unknown
  Kingdom: Bacteria, Phylum: Proteobacteria, Class: Betaproteobacteria, Order: Neisseriales, Family: Neisseriaceae, Genus:
tacgtagggtgcgagcgttaatcggaattattgggcgtaaagcgagtgtagacggttatttaagccagatgtgaaatacccgagcctaacttgggaggtgcatttggaactgggtagctagagtgtgtcagagggaggtagaactccacgtgtagcagtgaaatgcgtagagatgtggaagaataccgatggcgaaggcagcctcctgggataactgacgttgaggctcgaaagcgtggggagcaaacagg

SEQ ID NO: 1024 - DNA, 254 bp, Unknown
  Kingdom: Bacteria, Phylum: Proteobacteria, Class: Betaproteobacteria, Order: Nitrosomonadales, Family: Nitrosomonadaceae, Genus:
atacgtagggtgcgagcgttaatcggaattactgggcgtaaagcgtgcgcaggcggttttgtaagccagatgtgaaatccccgggcttaacctgggaatggcatttgggactgcaaggctggagtgcggcagaggagactggaattcctggtgtagcagtgaaatgcgtagatatcaggaggaataccgatggcgaaggcaggtctctgggctgacactgacgctcatgcacgaaagcgtggggagcaaacagg

SEQ ID NO: 1025 - DNA, 254 bp, Unknown
  Kingdom: Bacteria, Phylum: Proteobacteria, Class: Betaproteobacteria, Order: Nitrosomonadales, Family: Nitrosomonadaceae, Genus:
atacgtagggtgcgagcgttaatcggaattactgggcgtaaagtgtgcgcaggcggcgtcgcaagtcgagtgtgaaagccccgggcttaacttgggaattgcgctcgaaactacgatgctggagtgtggcagaggaaggtggaattccacgtgtagcggtgaaatgcgtagagatgtggaggaacaccaatggcgaaggcagccttctgggccaacactgacgctcatgcacgaaagcgtggggagcaaacagg

SEQ ID NO: 1026 - DNA, 254 bp, Unknown
  Kingdom: Bacteria, Phylum: Proteobacteria, Class: Betaproteobacteria, Order: Nitrosomonadales, Family: Nitrosomonadaceae, Genus:
atacgtagggtgcgagcgttaatcggaattactgggcgtaaagcgtgcgcaggcggttttgtaagccagatgtgaaagccccgggcttaacctgggaatggcatttgggactgcaaggcttgagtgcggcagaggagactggaattcctggtgtagcagtgaaatgcgtagatatcaggaggaataccgatggcgaaggcaggtctctgggctgacactgacgctcatgcacgaaagcgtggggagcaaacagg

SEQ ID NO: 1027 - DNA, 254 bp, Unknown
  Kingdom: Bacteria, Phylum: Proteobacteria, Class: Betaproteobacteria, Order: Nitrosomonadales, Family: Nitrosomonadaceae, Genus:
atacgtagggtgcgagcgttaatcggaattactgggcgtaaagcgtgcgcaggcggttttgtaagccagatgtgaaatccccgggcttaacctgggaatggcatttgggactgcaaggctggagtttggcagaggagactggaattcctggtgtagcagtgaaatgcgtagatatcaggaggaataccgatggcgaaggcaggtctctgggctataactgacgctcatgcacgaaagcgtggggagcaaacagg

SEQ ID NO: 1028 - DNA, 254 bp, Unknown
  Kingdom: Bacteria, Phylum: Proteobacteria, Class: Betaproteobacteria, Order: Nitrosomonadales, Family: Nitrosomonadaceae, Genus:
atacgtagggtgcgagcgttaatcggaattactgggcgtaaagcgtgcgcaggcggttcgccaagtcaggtgtgaaatccccgggcttaacctgggaattgcgcttgaaactagcgggcttgagtgtggcagaggggggtggaattccacgtgtagcagtgaaatgcgtagagatgtggaggaacaccgatggcgaaggcagccccctgggtcaacactgacgctcatgcacgaaagcgtggggagcaaacagg

SEQ ID NO: 1029 - DNA, 254 bp, Unknown
  Kingdom: Bacteria, Phylum: Proteobacteria, Class: Betaproteobacteria, Order: Nitrosomonadales, Family: Nitrosomonadaceae, Genus:
atacgtagggtgcgagcgttaatcggaattactgggcgtaaagcgtgcgcaggcggttcgccaagtcaggtgtgaaatccccgggcttaacctgggaattgcgcttgaaactagcgggcttgagtgcggcagaggggggtggaattccacgtgtagcagtgaaatgcgtagagatgtggaggaacaccgatggcgaaggcagccccctgggtcgacactgacgctcatgcacgaaagcgtggggagcaaacagg

SEQ ID NO: 1030 - DNA, 254 bp, Unknown
  Kingdom: Bacteria, Phylum: Proteobacteria, Class: Betaproteobacteria, Order: TRA3-20, Family:  , Genus:
atacgtagggtgcaggcgttaatcggaattactgggcgtaaagcgtgcgcaggcggtttgctaagacaggtgtgaaatccccgagcttaacttgggaattgcgcttgtaactggcaagctagagtgtggcagaggggggtggaattccacgtgtagcagtgaaatgcgtagatatgtggaggaacaccgatggcgaaggcagccccctgggttaacactgacgctcatgcacgaaagcgtggggagcaaacagg

SEQ ID NO: 1031 - DNA, 254 bp, Unknown
  Kingdom: Bacteria, Phylum: Proteobacteria, Class: Betaproteobacteria, Order: TRA3-20, Family:  , Genus:
atacgtagggtgcgagcgttaatcggaattactgggcgtaaagcgtgcgcaggcggttcgacaagtctgatgtgaaatccccgggctcaacctgggaactgcgttggaaactgtcgggctagagtgtagaagaggggggtagaattccacgtgtagcagtgaaatgcgtagagatgtggaggaataccgatggcgaaggcagccccctgggctaacactgacgctcatgcacgaaagcgtggggagcaaacagg

SEQ ID NO: 1032 - DNA, 254 bp, Unknown
  Kingdom: Bacteria, Phylum: Proteobacteria, Class: Betaproteobacteria, Order: TRA3-20, Family:  , Genus:
atacgtagggtgcaggcgttaatcggaattactgggcgtaaagcgtgcgcaggcggtttgttaagacagatgtgaaatccccgggcttaacctgggaactgcgtttgtaactggcagactggagtgtggcagaggggggtggaattccaagtgtagcagtgaaatgcgtagatatttggaggaacaccgatggcgaaggcagccccctgggctaacactgacgctcatgcacgaaagcgtggggagcaaacagg

SEQ ID NO: 1033 - DNA, 254 bp, Unknown
  Kingdom: Bacteria, Phylum: Proteobacteria, Class: Deltaproteobacteria, Order: Bdellovibrionales, Family: Bacteriovoracaceae, Genus: Bacteriovorax
atacgaagggtgcaagcgttgttcggatttatcgggcgtaaagcgcgcgtaggcggacctgcaagtcagatgtgaaatctcggggctcaacctcgaaactgcgtctgaaactacaggtctagaatcttggagggggaaggggaatttcgcatgtaggggtaaaatccgtagatatgcgaaggaacaccagaggcgaaggcgccttcctggacaagtattgacgctgaggcgcgaaagcgtggggatcaaacagg

SEQ ID NO: 1034 - DNA, 254 bp, Unknown
  Kingdom: Bacteria, Phylum: Proteobacteria, Class: Deltaproteobacteria, Order: Bdellovibrionales, Family: Bacteriovoracaceae, Genus: Bacteriovorax
atacgaagggtgcaagcgttgttcggatttattgggcgtaaagcgcgcgtaggcggacctgcaagtcagatgtgaaatctcggggctcaaccccgaaactgcgtctgaaactacaggtctagaatctcggagggggaaggggaatatcgcatgtaggggtaaaatccgtagatatgcgatggaacaccagaggcgaaggcgccttcctggacgagtattgacgctgaggcgcgaaagcgtggggatcaaacagg

SEQ ID NO: 1035 - DNA, 254 bp, Unknown
  Kingdom: Bacteria, Phylum: Proteobacteria, Class: Deltaproteobacteria, Order: Bdellovibrionales, Family: Bacteriovoracaceae, Genus:
atacgaagggtgcaagcgttgttcggaatcattgggcgtaaagcgcgcgcaggcggatcagcaagtcagatgtgaaatctcgaagctcaacttcgaaactgcgtctgaaactgctagtctagaatgtcggagggggcaggggaatttcacgtgtaggggtaaaatccgtagagatgtgaaggaacaccggaggcgaaggcgcctgcctggacgactattgacgctgaggcgcgaaagcgtggggagcaaacagg

SEQ ID NO: 1036 - DNA, 251 bp, Unknown
  Kingdom: Bacteria, Phylum: Proteobacteria, Class: Deltaproteobacteria, Order: Bdellovibrionales, Family: Bacteriovoracaceae, Genus:
tacgaagggtgcaagcgttgttcggatttattgggcgtaaagcgcgcgtaggcggacctgcaagtcagatgtgaaatctcggggctcaacctcgaaactgcgtctgaractacaggtctagaatctcggagggggaaggggaatttcgcatgtaggggtaaaatccgtagatatgcgaaggaacaccagaggcgaaggcgccttcctggacgaattgacgctgaggcgcgaaagcgtggggatcaaacagg

SEQ ID NO: 1037 - DNA, 254 bp, Unknown
  Kingdom: Bacteria, Phylum: Proteobacteria, Class: Deltaproteobacteria, Order: Bdellovibrionales, Family: Bdellovibrionaceae, Genus: Bdellovibrio
agacgaggggtcctagcgttgttcggaatcattgggcgtaaagcgggtgtaggtggctttgtaagtcagaagtgaaagccctgggctcaacccaggaagtgcttttgatactgcagagcttgagtgtgggagaggatgctggaattccaggtgtagtggtgaaatacgtagatatctggaggaacaccggtggcgaaggcgggcatctggcccaacactgacactcagacccgaaagcgtggggatcaaacagg

SEQ ID NO: 1038 - DNA, 251 bp, Unknown
  Kingdom: Bacteria, Phylum: Proteobacteria, Class: Deltaproteobacteria, Order: Bdellovibrionales, Family: Bdellovibrionaceae, Genus: Bdellovibrio
tacgagggatcctagcgttgttcggaatcattgggcgtaaagggtgtgtaggcggccatgtaagtcagttgtgaaagccccgggctcaacccgggaagtgcttctgatactgcttggcttgagtattggataggtgagtggaattccaggtgtagtggtgaaatacgtagatatctggaggaacaccggcggcgaaggcggctcactggccatactgacgctgaaacacgaaagcgtgggtagcaaacagg

SEQ ID NO: 1039 - DNA, 251 bp, Unknown
  Kingdom: Bacteria, Phylum: Proteobacteria, Class: Deltaproteobacteria, Order: Bdellovibrionales, Family: Bdellovibrionaceae, Genus:
gacgagggatcctagcgttgttcggaatcattgggcgtaaagcgggtgtaggtggctttgtaagtcgagtgtgaaagcctggggctcaaccccagaagtgcattcgatactgcgaagcttgagtggtagagaggttagtagaattgttggtgtagtggtgaaatacgtagatatcaacaggaataccggaggcgaaggcggctaactggctacactgacactcagacccgaaagtgcggggatcaaacagg

SEQ ID NO: 1040 - DNA, 254 bp, Unknown
  Kingdom: Bacteria, Phylum: Proteobacteria, Class: Deltaproteobacteria, Order: Bdellovibrionales, Family: Bdellovibrionaceae, Genus:
agacgaggggtccaagcgttgttcggaattattgggcgtaaagcgggtgtaggtggctctataagtcaggagtgaaagccccgagcttaacttgggaagtgcttttgatactgtagagcttgaatgtgggagaggatcgtggaattccaggtgtagtggtgaaatacgtagatatctggaggaacaccggtggcgaaggcggcgatctggcccaacattgacactgagacccgaaagcgtggggatcaaacagg

SEQ ID NO: 1041 - DNA, 254 bp, Unknown
  Kingdom: Bacteria, Phylum: Proteobacteria, Class: Deltaproteobacteria, Order: Desulfuromonadales, Family: GR-WP33-58, Genus:
atacggagggtgcaagcgttgttcggaattactgggcgtaaagcgcgcgcaggcggcattataagtcgggtgtgaaatccctgggcttaacccaggacgtgcgcctgatactgtgatgctagaatctgggagagggatgtggaattcctggtgtagaggtgaaattcgtagagatcaggaggaacactcgtggcgaaggcgacatcctggaccaagattgacgctgaggcgcgaaagcgtggggagcaaacagg

SEQ ID NO: 1042 - DNA, 254 bp, Unknown
  Kingdom: Bacteria, Phylum: Proteobacteria, Class: Deltaproteobacteria, Order: GR-WP33-30, Family:  , Genus:
atacagagggtgcaagcgttgttcggaattattgggcgtaaagggcgtgtaggcggtctgctaagtcatgtgtgaaatccctcggcttaaccgaggaacgacgcatgaaactggcaagctagagtaccaaagaggggggtggaattcccggtgtagcggtgaaatgcgtagatatcgggaggaacaccggtggcgaaggcggccccctggttggatactgacgctgagacgcgaaagcgtggggagcaaacagg

SEQ ID NO: 1043 - DNA, 254 bp, Unknown
  Kingdom: Bacteria, Phylum: Proteobacteria, Class: Deltaproteobacteria, Order: GR-WP33-30, Family:  , Genus:
atacagagggtgcaagcgttgttcggaatcattgggcgtaaagggcgtgtaggcggtctgttaagtcatgtgtgaaatccctcggctcaaccggggaacgacgcatgaaactgacaagctagagtaccaaagaggggggtggaattcccggtgtagcggtgaaatgcgtagatatcgggaggaacaccggtggcgaaggcggccccctggttggatactgacgctgagacgcgaaagcgtggggagcaaacagg

SEQ ID NO: 1044 - DNA, 254 bp, Unknown
  Kingdom: Bacteria, Phylum: Proteobacteria, Class: Deltaproteobacteria, Order: GR-WP33-30, Family:  , Genus:
agacggagggtgcaagcgttgttcggattgactgggcgtaaagggcgtgtaggcggtttgttaagtcgggtgtgaaagcccggggctcagctccggaagtgcgcccgaaactggcgagctggagcgcggtagaggagggtggaattcctggtgtagcggtgaaatgcgtagatatcaggaggaacaccggcggcgaaggcggccctctggaccgttgctgacgctgagacgcgaaagcgtggggagcaaacagg

SEQ ID NO: 1045 - DNA, 254 bp, Unknown
  Kingdom: Bacteria, Phylum: Proteobacteria, Class: Deltaproteobacteria, Order: Myxococcales, Family: 0319-6G20, Genus:
atacgaaaggtgcaagcgttactcggaatcactgggcgtaaagcgcacgtaggcggactcgcaggtcaattgtgaaatacctgggctcaacccgggaactgcagttgaaaccgcttgtcttgaatacctgagagggtgggggaatacctggtggagaagtgaaattcgtagagatcaggtggaacaccggaggcgaaggcgcctgcctggcagtgtattgacgctgaggtgcgaaagtgcggggagcaaacagg

SEQ ID NO: 1046 - DNA, 254 bp, Unknown
  Kingdom: Bacteria, Phylum: Proteobacteria, Class: Deltaproteobacteria, Order: Myxococcales, Family: 0319-6G20, Genus:
atacagagggtgcaagcgttgttcggaattactgggcgtaaagcgtgcgtagtcggtattgagagtcacgggtgaaatcccaaggcttaaccttggaactgcctgtgagacctcagtactagagtgtgagaggggatagtggaatacccagtgtagcggtgaaatgcgtagagattgggtggaacaccggtggcgaaggcggctatctggctcacaactgacgatcaggcacgaaagcgtggggagcaaacagg

SEQ ID NO: 1047 - DNA, 254 bp, Unknown
  Kingdom: Bacteria, Phylum: Proteobacteria, Class: Deltaproteobacteria, Order: Myxococcales, Family: 0319-6G20, Genus:
atacagagggtgcaagcgttgttcggaattactgggcgtaaagcgtgcgtagtcggtattgagagtcgcgggtgaaatcccagggcttaaccctggaactgcctgcgagacctcagtactagagtgtgagaggggatagtggaatacccagtgtagcggtgaaatgcgtagagattgggtggaacaccggtggcgaaggcggctatctggctcacaactgacgatcaggcacgaaagcgtggggagcaaacagg

SEQ ID NO: 1048 - DNA, 254 bp, Unknown
  Kingdom: Bacteria, Phylum: Proteobacteria, Class: Deltaproteobacteria, Order: Myxococcales, Family: 0319-6G20, Genus:
atacgaagggtgcaagcgttgctcggaattattgggcgtaaagggtaggtaggttgtcttgtttgtctaaggtgaaatcccatggcttaactgtggaagtgccttagaaacggcaagactagagtcctagaggggtttgtggaattcccggtgtagcggtgaaatgcgtagagatcgggaggaacaccagcggcgaaggcggcaaactggataggaactgacactcaactacgaaagcgtggggatcaaacagg

SEQ ID NO: 1049 - DNA, 254 bp, Unknown
  Kingdom: Bacteria, Phylum: Proteobacteria, Class: Deltaproteobacteria, Order: Myxococcales, Family: Haliangiaceae, Genus: Haliangium
atacgaagggtgcaaacgttgctcggaattattgggcgtaaagcgcacgtaggcggcttagcaagtcggaagtgaaatccctcggctcaaccaaggaagtgctttcgaaactgctgagcttgagtacttaagaggatcgcggaattcccggtgtagaggtgaaattcgtagatatcgggaggaacaccagtggcgaaggcggcgatctgggaagatactgacgctgaggtgcgaaagcgtggggagcaaacagg

SEQ ID NO: 1050 - DNA, 254 bp, Unknown
  Kingdom: Bacteria, Phylum: Proteobacteria, Class: Deltaproteobacteria, Order: Myxococcales, Family: Haliangiaceae, Genus:
atacgaagggtgcaaacgttgctcggaatcattgggcgtaaagcgcacgtaggcggctccgtaagtcggatgtgaaatccctcggcttaaccgaggacgtgcatccgaaactgtggagctcgagtatggaagagggtcgcagaattcccggtgtagaggtgaaattcgtagatatcgggaggaataccagtggcgaaggcggcgacctgggccaatactgacgctgaggtgcgaaagcgtggggagcaaacagg

SEQ ID NO: 1051 - DNA, 254 bp, Unknown
  Kingdom: Bacteria, Phylum: Proteobacteria, Class: Deltaproteobacteria, Order: Myxococcales, Family: Haliangiaceae, Genus:
atacgaagggtgcaaacgttgctcggaattattgggcgtaaagcgcacgtaggcggctttgcaagtcggatgtgaaatccctcggcttaaccaaggaagtgcatccgaaactgcagagcttgagtacttaagaggatcgcggaattcccggtgtagaggtgaaattcgtagatatcgggaggaacaccagtggcgaaggcggcgatctgggaagatactgacgctgaggtgcgaaagcgtggggagcaaacagg

SEQ ID NO: 1052 - DNA, 254 bp, Unknown
  Kingdom: Bacteria, Phylum: Proteobacteria, Class: Deltaproteobacteria, Order: Myxococcales, Family: Haliangiaceae, Genus:
atacgaagggtgcaaacgttgctcggaattattgggcgtaaagcgcacgtaggcggcttagcaagtcggatgtgaaatccctcggctcaaccaaggaagtgcatccgaaactgctgagcttgagtacgaaagaggatcgcggaattcccggtgtagaggtgaaattcgtagatatcgggaggaacaccagtggcgaaggcggcgatctgggtcgatactgacgctgaggtgcgaaagcgtggggagcaaacagg

SEQ ID NO: 1053 - DNA, 254 bp, Unknown
  Kingdom: Bacteria, Phylum: Proteobacteria, Class: Deltaproteobacteria, Order: Myxococcales, Family: Myxococcaceae, Genus: Corallococcus
atacagagggtgcaagcgttgttcggaattattgggcgtaaagcgcgtgtaggcggctttgcaagtcgggtgtgaaagccctcagctcaactgaggaagtgcgcccgaaactgcagagcttgagtgccggagagggtggcggaattccccaagtagaggtgaaattcgtagatatggggaggaacaccggtggcgaaggcggccacctggacggtaactgacgctgagacgcgaaagcgtgggtagcaaacagg

SEQ ID NO: 1054 - DNA, 254 bp, Unknown
  Kingdom: Bacteria, Phylum: Proteobacteria, Class: Deltaproteobacteria, Order: Myxococcales, Family: Polyangiaceae, Genus:
agacagagggtgcaaacgttgttcggaattactgggcgtaaagcgcatgtaggcggttcgtaaagtcagatgtgaaagccctgggcttaacccaggaagtgcatttgaaactcacgaacttgagtcccggagaggaaggcggaattctcggtgtagaggtgaaattcgtagatatcgagaggaacatcggtggcgaaggcggccttctggacggtgactgacgctgagatgcgaaagcgtggggagcaaacagg

SEQ ID NO: 1055 - DNA, 254 bp, Unknown
  Kingdom: Bacteria, Phylum: Proteobacteria, Class: Deltaproteobacteria, Order: Myxococcales, Family: Sandaracinaceae, Genus:
agacagagggtgcaaacgttgctcggaattactgggcgtaaagcgcgtgtaggcgggaagataagtcgggtgtgaaatccctgggctcaacctaggaactgcatccgaaactgcctttctggagtgatggagaggaaagcggaattcccggtgtagaggtgaaattcgtagatatcgggaggaacaccagtggcgaaggcggctttctggccatcaactgacgctgagacgcgaaagcgtggggagcaaacagg

SEQ ID NO: 1056 - DNA, 254 bp, Unknown
  Kingdom: Bacteria, Phylum: Proteobacteria, Class: Deltaproteobacteria, Order: Myxococcales, Family: Sandaracinaceae, Genus:
agacagagggtgcaaacgttgctcggaatcactgggcgtaaagggcgtgtaggcgggaatgtaagtcgggcgtgaaatccctaggctcaacctaggaactgcactcgaaactgcgtttcttgagtatcggagaggaaagcggaatacctggtgtagaggtgaaattcgtagatatcaggtggaacaccagtggcgaaggcggctttctggacgataactgacgctgagacgcgaaagcgtggggagcaaacagg

SEQ ID NO: 1057 - DNA, 254 bp, Unknown
  Kingdom: Bacteria, Phylum: Proteobacteria, Class: Deltaproteobacteria, Order: Myxococcales, Family:  , Genus:
atacagagggtgcaagcgttgttcggaattattgggcgtaaagcgcgtgtaggcggcttggcaagtcagatgtgaaagccctcggcttaaccgaggaagtgcgtctgaaactgctgagcttgagtgtcggagaggatggcggaattccgcaagtagaggtgaaattcgtagatatgcggaggaacaccggtggcgaaggcggccatctggacgactactgacgctgagacgcgaaagcgtggggagcaaacagg

SEQ ID NO: 1058 - DNA, 251 bp, Unknown
  Kingdom: Bacteria, Phylum: Proteobacteria, Class: Deltaproteobacteria, Order: Myxococcales, Family:  , Genus:
gacagagggtgcaaacgttgttcggaattactgggcgtaaagcgcgtgtaggcggccctgcaagtcggatgtgaaatcccacggctcaaccatggaagtgcattcgaaactgcagagctagagtcctggagaggaaggtggaatgcttggtgtagaggtgaaattcgtagatatcaagcggaacaccggtggcgaaggcggccttctggacagactgacgctgagacgcgaaagcgtggggagcaaacagg

SEQ ID NO: 1059 - DNA, 251 bp, Unknown
  Kingdom: Bacteria, Phylum: Proteobacteria, Class: Deltaproteobacteria, Order: Myxococcales, Family:  , Genus:
gacagagggtgcaaacgttgttcggaattactgggcgtaaagcgcgtgtaggcggccctgcaagtcgggtgtgaaatcccatggctcaaccatggaagtgcactcgaaactgcagggctagagtcctggagaggaaggtggaatgcttggtgtagaggtgaaattcgtagatatcaagcggaacaccggtggcgaaggcggccttctggacagactgacgctgagacgcgaaagcgtggggagcaaacagg

SEQ ID NO: 1060 - DNA, 251 bp, Unknown
  Kingdom: Bacteria, Phylum: Proteobacteria, Class: Deltaproteobacteria, Order: Myxococcales, Family:  , Genus:
gacagagggtgcaaacgttgttcggaattactgggcgtaaagcgcgtgtaggcggctaagtaagtcgggcgtgaaatcccacggctcaaccgtggaagtgcactcgaaactgcatagctagagtcctggagaggaaggtggaatgcttggtgtagaggtgaaattcgtagatatcaagcggaacaccggtggcgaaggcggccttctggacagactgacgctgagacgcgaaagcgtggggagcaaacagg

SEQ ID NO: 1061 - DNA, 254 bp, Unknown
  Kingdom: Bacteria, Phylum: Proteobacteria, Class: Deltaproteobacteria, Order: Myxococcales, Family:  , Genus:
atacagagggtgcaagcgttgttcggaattattgggcgtaaagcgcgtgtaggcggctttgcaagtcgggtgtgaaagccctcggctcaaccgaggaagtgcgcccgaaactgcagagcttgagtaccggagaggatggcggaattccccaagtagaggtgaaattcgtagatatggggaggaacaccggtggcgaaggcggccatctggacggatactgacgctgagacgcgaaagcgtgggtagcaaacagg

SEQ ID NO: 1062 - DNA, 251 bp, Unknown
  Kingdom: Bacteria, Phylum: Proteobacteria, Class: Deltaproteobacteria, Order: Myxococcales, Family:  , Genus:
tacagggggtgcaaacgttgctcggaatcattgggcgtaaagcgcacgtaggcggttcgttatgtcggatgtgaaagcccttggcttaaccgaggaagtgcatccgaaactggcgagctagagtactaaagaggatcgcggaattcccggtgtagaggtgaaattcgtagatatcgggaggaacaccggtggcgaaggcggcgatctgggtagactgacgctgaggtgcgaaagcgtggggagcaaacagg

SEQ ID NO: 1063 - DNA, 255 bp, Unknown
  Kingdom: Bacteria, Phylum: Proteobacteria, Class: Deltaproteobacteria, Order: Myxococcales, Family:  , Genus:
agacagagggtgcaagcgttgttcggaattattgggcgtaaagggcgcgtaggcggcccatcaagtcggatgtgaaagcccagggctcaaccttggaagtgcatccgaaactgatgagctagagttcacggagagggtggtggaattcccagtgtagaggtgaaattcgtagatattgggaggaacaccggtggcgaaggcgaccacctggacggaaactgacgctgaggcgcgaaagcgtgggtagcaaacagg

SEQ ID NO: 1064 - DNA, 251 bp, Unknown
  Kingdom: Bacteria, Phylum: Proteobacteria, Class: Deltaproteobacteria, Order: Myxococcales, Family:  , Genus:
gacagagggtgcaaacgttgttcggaattactgggcgtaaagcgcgtgtaggcggcttcgcaagtcgggtgtgaaatcccacggctcaaccgtggaagtgtattcgaaactgcaaggctagagtcctggagaggaaggtggaatgcttggtgtagaggtgaaattcgtagatatcaagcggaacaccggtggcgaaggcgaccttctggacagactgacgctgagacgcgaaagcgtggggagcaaacagg

SEQ ID NO: 1065 - DNA, 254 bp, Unknown
  Kingdom: Bacteria, Phylum: Proteobacteria, Class: Deltaproteobacteria, Order: Myxococcales, Family:  , Genus:
atacagagggtgcaagcgttgttcggaattattgggcgtaaagcgcgtgtaggcggctttgcaagtcgggtgtgaaagccctcggctcaaccgaggaagtgcgcccgaaactgcagagcttgagtaccggagaggatggcggaattccccaagtagaggtgaaattcgtagatatggggaggaacaccggtggcgaaggcggccatctggacggatactgacgctgagacgcgaaagcgtggggagcaaacagg

SEQ ID NO: 1066 - DNA, 251 bp, Unknown
  Kingdom: Bacteria, Phylum: Proteobacteria, Class: Deltaproteobacteria, Order: Myxococcales, Family:  , Genus:
gacagaaggtgcaaacgttgctcggaatcactgggcgtaaagggcgtgtaggcgggacagtaagtcgggcgtgaaatccctgggctcaacccaggaactgcactcgaaactactattcttgagtgtcggagaggaaagcggaattcctggtgtagaggtgaaattcgtagatatcaggaggaacaccagtggcgaaggcggctttctggacgaactgacgctgagacgcgaaagcgtggggagcaaacagg

SEQ ID NO: 1067 - DNA, 254 bp, Unknown
  Kingdom: Bacteria, Phylum: Proteobacteria, Class: Deltaproteobacteria, Order: Myxococcales, Family:  , Genus:
agacagagggtgcaaacgttgttcggaattactgggcgtaaagcgcgtgtaggcggcagggcatgtcggatgtgaaatcccgtggctcaaccacggaagtgcacccgaaactgcccagctggagtctcggagaggaaggcggaatgcttggtgtagaggtgaaattcgtagatatcaagcggaacaccggtggcgaaggcggccttctggacgatgactgacgctgagacgcgaaagcgtggggagcaaacagg

SEQ ID NO: 1068 - DNA, 251 bp, Unknown
  Kingdom: Bacteria, Phylum: Proteobacteria, Class: Deltaproteobacteria, Order: Myxococcales, Family:  , Genus:
gacagagggtgcaaacgttgttcggatttactgggcgtaaagcgcgtgtaggcggcttggcaagtcggatgtgaaagcccacggctcaaccgtggaagcgcatccgaaactgcttcgcttgagtctcggagaggaaggtggaatgcttggtgtagaggtgaaattcgtagatatcaagcagaacacctgcggcgaaggcggccttctggacgaactgacgctgagacgcgaaagcgtggggagcaaacagg

SEQ ID NO: 1069 - DNA, 254 bp, Unknown
  Kingdom: Bacteria, Phylum: Proteobacteria, Class: Deltaproteobacteria, Order: Myxococcales, Family:  , Genus:
agacagagggtgcaaacgttgttcggaattactgggcgtaaagcgcgtgtaggcggctatgtaagtcgggcgtgaaatcccacggctcaaccgtggaagtgcacccgaaactgtgtagctagagtcctggagaggaaggtggaatgcttggtgtagaggtgaaattcgtagatatcaagcggaacaccggtggcgaaggcggccttctggacagtgactgacgctgagacgcgaaagcgtggggagcaaacagg

SEQ ID NO: 1070 - DNA, 254 bp, Unknown
  Kingdom: Bacteria, Phylum: Proteobacteria, Class: Deltaproteobacteria, Order: Myxococcales, Family:  , Genus:
agacagagggtgcaaacgttgttcggaattactgggcgtaaagcgcgtgtaggcggccctgcaagtcggatgtgaaatcccacggctcaaccgtggaagtgcattcgaaactgcagggctagagtcctggagaggaaggtggaatgcttggtgtagaggtgaaattcgtagatatcaagcggaacaccggtggcgaaggcggccttctggacagtgactgacgctgagacgcgaaagcgtggggagcaaacagg

SEQ ID NO: 1071 - DNA, 254 bp, Unknown
  Kingdom: Bacteria, Phylum: Proteobacteria, Class: Deltaproteobacteria, Order: Sh765B-TzT-29, Family:  , Genus:
atacggagggtgcaagcgttgttcggaatcattgggcgtaaagcgcgtgtaggcggcttggcaagtcggttgtgaaagcccggggcccaaccccggaattgcatctgaaactgcctcgctagagtcccggagaggaaggcagaattcccggtgtaggggtgaaatccgtagatatcgggaggaataccagcggcgaaggcggccttctggacggtgactgacgctgagacgcgaaagcgtggggagcaaacagg

SEQ ID NO: 1072 - DNA, 251 bp, Unknown
  Kingdom: Bacteria, Phylum: Proteobacteria, Class: Deltaproteobacteria, Order: Spirobacillales, Family:  , Genus:
tacgaaaggtccaagcgttactcggaattactgggcgtaaagcgcgcgtaggcggctttgtatgtcgattgtgaaagccccgggctcaacctgggaactgcagtcgaaactgcaaagcttgaatgttggagaggttgggggaatacctagtggagaagtgaaattcgtagagattaggtggaacaccagaggcgaaggcgcctgactggccaaattgacgctgaggcgcgaaagcgtgggtagcaaacagg

SEQ ID NO: 1073 - DNA, 251 bp, Unknown
  Kingdom: Bacteria, Phylum: Proteobacteria, Class: Deltaproteobacteria, Order: Syntrophobacterales, Family: Syntrophobacteraceae, Genus:
gacggaaggtgcaagcgttgctcggaatcactgggcgtaaagggtgcgtaggcggccgtgcaagtctggcgtgaaagccccgggctcagcccgggaagtgcgctcgaaactgcgcggctcgagtgccggaggggagagtggaattcctggtgtagcggtgaaatgcgtagatatcaggaggaataccggtggcgaaagcgactctctggacggactgacgctgaggcacgaaagcgtggggagcaaacagg

SEQ ID NO: 1074 - DNA, 251 bp, Unknown
  Kingdom: Bacteria, Phylum: Proteobacteria, Class: Gammaproteobacteria, Order: Alteromonadales, Family: Alteromonadaceae, Genus:
tacggagggtgcaagcgttaatcggaattactgggcgtaaagcgcgcgtaggcggccatttaagctagatgtgaaagcccagggcttaaccttggaactgcatttagaactggatggctagagtatggaagaggagtgtggaatttcaggtgtagcggtgaaatgcgtagagatctgaaggaacatcagtggcgaaggcgacactctggtccaactgacgctgaggtgcgaaagcgtggggatcaaacagg

SEQ ID NO: 1075 - DNA, 254 bp, Unknown
  Kingdom: Bacteria, Phylum: Proteobacteria, Class: Gammaproteobacteria, Order: Alteromonadales, Family: Shewanellaceae, Genus:
atacggagggtccgagcgttaatcggaattactgggcgtaaagcgtgcgcaggcggtttgttaagcgagatgtgaaagccctgggctcaacctaggaatagcatttcgaactggcgaactagagtcttgtagaggggggtagaattccaggtgtagcggtgaaatgcgtagagatctggaggaataccggtggcgaaggcggccccctggacaaagactgacgctcatgcacgaaagcgtggggagcaaacagg

SEQ ID NO: 1076 - DNA, 254 bp, Unknown
  Kingdom: Bacteria, Phylum: Proteobacteria, Class: Gammaproteobacteria, Order: Chromatiales, Family: Chromatiaceae, Genus:
atacagagggtgcaagcgttaatcggaattactgggcgtaaagcgcacgtaggcggttggttaagttggatgtgaaagccccgggctcaacctgggaattgcattcaaaactggccaactagaatacgggagaggggggtagaattccaagtgtagcggtgaaatgcgtagagatttggaggaataccagtggcgaaggcggccccctggcccgatattgacgctgaggtgcgaaagcgtggggagcaaacagg

SEQ ID NO: 1077 - DNA, 254 bp, Unknown
  Kingdom: Bacteria, Phylum: Proteobacteria, Class: Gammaproteobacteria, Order: Enterobacteriales, Family: Enterobacteriaceae, Genus:
atacggagggtgcaagcgttaatcggaattactgggcgtaaagcgcacgcaggcggtctgtcaagtcggatgtgaaatccccgggcttaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacagg

SEQ ID NO: 1078 - DNA, 254 bp, Unknown
  Kingdom: Bacteria, Phylum: Proteobacteria, Class: Gammaproteobacteria, Order: Enterobacteriales, Family: Enterobacteriaceae, Genus:
atacggagggtgcaagcgttaatcggaattactgggcgtaaagcgcacgcaggcggtttgttaagtcagatgtgaaatccccgggctcaacctgggaactgcatttgaaactggcaagctagagtctcgtagaggggggtagaattccaggtgtagcggtgaaatgcgtagagatctggaggaataccggtggcgaaggcggccccctggacgaagactgacgctcaggtgcgaaagcgtggggagcaaacagg

SEQ ID NO: 1079 - DNA, 254 bp, Unknown
  Kingdom: Bacteria, Phylum: Proteobacteria, Class: Gammaproteobacteria, Order: Enterobacteriales, Family: Enterobacteriaceae, Genus:
atacggagggtgcaagcgttaatcggaattactgggcgtaaagcgcacgcaggcggtctgttaagtcagatgtgaaatccccgggctcaacccgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacagg

SEQ ID NO: 1080 - DNA, 254 bp, Unknown
  Kingdom: Bacteria, Phylum: Proteobacteria, Class: Gammaproteobacteria, Order: Enterobacteriales, Family: Enterobacteriaceae, Genus:
atacggagggtgcaagcgttaatcggaattactgggcgtaaagcgcacgcaggcggtctgtcaagtcggatgtgaaatccccgggctcaacctgggaactgcatccgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacagg

SEQ ID NO: 1081 - DNA, 254 bp, Unknown
  Kingdom: Bacteria, Phylum: Proteobacteria, Class: Gammaproteobacteria, Order: Enterobacteriales, Family: Enterobacteriaceae, Genus:
atacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaagaccggtggcgaaggcggccccctggacaaagactgacgctcaggtgcgaaagcgtggggagcaaacagg

SEQ ID NO: 1082 - DNA, 254 bp, Unknown
  Kingdom: Bacteria, Phylum: Proteobacteria, Class: Gammaproteobacteria, Order: Enterobacteriales, Family: Enterobacteriaceae, Genus:
atacggagggtgcaagcgttaatcggaattactgggcgtaaagcgcacgcaggcggtctgtcaagtcggatgtgaaatccccgggctcaacccgggaactgcattcgaaactggcagactagagtcttgtagaggggggtagaattccaggtgtagcggtgaaatgcgtagagatctggaggaataccggtggcgaaggcggccccctggacaaagactgacgctcaggtgcgaaagcgtggggagcaaacagg

SEQ ID NO: 1083 - DNA, 254 bp, Unknown
  Kingdom: Bacteria, Phylum: Proteobacteria, Class: Gammaproteobacteria, Order: Enterobacteriales, Family: Enterobacteriaceae, Genus:
atacggagggtgcaagcgttaatcggaattactgggcgtaaagcgcacgcaggcggtctgtcaagtcggatgtgaaatccccgggctcaacctgggaactgcattcgaaactggcagactagagtcttgtagaggggggtagaattccaggtgtagcggtgaaatgcgtagagatctggaggaataccggtggcgaaggcggccccctggacaaagactgacgctcaggtgcgaaagcgtggggagcaaacagg

SEQ ID NO: 1084 - DNA, 254 bp, Unknown
  Kingdom: Bacteria, Phylum: Proteobacteria, Class: Gammaproteobacteria, Order: Enterobacteriales, Family: Enterobacteriaceae, Genus:
atacggagggtgcaagcgttaatcggaattactgggcgtaaagcgcacgcaggcggtctgtcaagtcggatgtgaaatccccgggcttaacctgggaactgcattcgaaactggcaggctggagtcttgtagaggggggtagaattccaggtgtagcggtgaaatgcgtagagatctggaggaataccggtggcgaaggcggccccctggacaaagactgacgctcaggtgcgaaagcgtggggagcaaacagg

SEQ ID NO: 1085 - DNA, 254 bp, Unknown
  Kingdom: Bacteria, Phylum: Proteobacteria, Class: Gammaproteobacteria, Order: Enterobacteriales, Family: Enterobacteriaceae, Genus:
atacggagggtgcaagcgttaatcggaattactgggcgtaaagcgcacgcaggcggtttgttaagtcagatgtgaaatccccgggctcaacctgggaactgcatctgatactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacagg

SEQ ID NO: 1086 - DNA, 254 bp, Unknown
  Kingdom: Bacteria, Phylum: Proteobacteria, Class: Gammaproteobacteria, Order: Enterobacteriales, Family: Enterobacteriaceae, Genus:
atacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacgaagactgacgctcaggtgcgaaagcgtggggagcaaacagg

SEQ ID NO: 1087 - DNA, 254 bp, Unknown
  Kingdom: Bacteria, Phylum: Proteobacteria, Class: Gammaproteobacteria, Order: Enterobacteriales, Family: Enterobacteriaceae, Genus:
atacggggggtgcaagcgttaatcggaattactgggcgtaaagcgcacgcaggcggtctgtcaagtcggatgtgaaatccccgggctcaacctgggaactgcattcgaaactggcaggctggagtcttgtagaggggggtagaattccaggtgtagcggtgaaatgcgtagagatctggaggaataccggtggcgaaggcggccccctggacaaagactgacgctcaggtgcgaaagcgtggggagcaaacagg

SEQ ID NO: 1088 - DNA, 254 bp, Unknown
  Kingdom: Bacteria, Phylum: Proteobacteria, Class: Gammaproteobacteria, Order: Enterobacteriales, Family: Enterobacteriaceae, Genus:
atacggagggtgcaagcgttaatcggaattactgggcgtaaagcgcacgcaggcggtctgtcaagtcagatgtgaaatccccgggcttaacctgggaactgcatttgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacagg

SEQ ID NO: 1089 - DNA, 254 bp, Unknown
  Kingdom: Bacteria, Phylum: Proteobacteria, Class: Gammaproteobacteria, Order: Enterobacteriales, Family: Enterobacteriaceae, Genus:
atacggagggtgcaagcgttaatcggaattactgggcgtaaagcgcacgcaggcggtctgttaagtcagatgtgaaatccccgggcttaacctgggaactgcatttgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacagg

SEQ ID NO: 1090 - DNA, 255 bp, Unknown
  Kingdom: Bacteria, Phylum: Proteobacteria, Class: Gammaproteobacteria, Order: Enterobacteriales, Family: Enterobacteriaceae, Genus:
atacggagggtgcagagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacagg

SEQ ID NO: 1091 - DNA, 254 bp, Unknown
  Kingdom: Bacteria, Phylum: Proteobacteria, Class: Gammaproteobacteria, Order: Enterobacteriales, Family: Enterobacteriaceae, Genus:
atacggagggtgcaagcgttaatcggaattactgggcgtaaagcgcacgcaggcggtctgtcaagtcggatgtgaaatccccgggctcaacctgggaactgcattcgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacagg

SEQ ID NO: 1092 - DNA, 254 bp, Unknown
  Kingdom: Bacteria, Phylum: Proteobacteria, Class: Gammaproteobacteria, Order: Enterobacteriales, Family: Enterobacteriaceae, Genus:
atacggagggtgcaagcgttaatcggaattactgggcgtaaagcgcacgcaggcggtctgtcaagtcggatgtgaaatccccgggctcaacctgggaactgcattcgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacagg

SEQ ID NO: 1093 - DNA, 254 bp, Unknown
  Kingdom: Bacteria, Phylum: Proteobacteria, Class: Gammaproteobacteria, Order: Enterobacteriales, Family: Enterobacteriaceae, Genus:
atacggagggtgcaagcgttaatcggaattactgggcgtaaagcgcacgcaggcggtctgtcaagtcggatgtgaaatccccgggctcaacctgggaactgcattcgaaactggcaggctggagtcttgtagaggggggtagaattccaggtgtagcggtgaaatgcgtagagatctggaggaataccggtggcgaaggcggccccctggacaaagactgacgctcaggtgcgaaagcgtggggagcaaacagg

SEQ ID NO: 1094 - DNA, 254 bp, Unknown
  Kingdom: Bacteria, Phylum: Proteobacteria, Class: Gammaproteobacteria, Order: Enterobacteriales, Family: Enterobacteriaceae, Genus:
atacggagggtgcaagcgttaatcggaattactgggcgtaaagcgcacgcaggcggtctgttaagtcagatgtgaaatccccgggctcaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacagg

SEQ ID NO: 1095 - DNA, 254 bp, Unknown
  Kingdom: Bacteria, Phylum: Proteobacteria, Class: Gammaproteobacteria, Order: Enterobacteriales, Family: Enterobacteriaceae, Genus:
atacggagggtgcaagcgttaatcggaattactgggcgtaaagcgcacgcaggcggtctgttaagtcagatgtgaaatccccgggcttaacctgggaactgcatttgaaactggcaggcttgagtcttgtagaggggggtagaattccaggtgtagcggtgaaatgcgtagagatctggaggaataccggtggcgaaggcggccccctgggcaaagactgacgctcaggtgcgaaagcgtggggagcaaacagg

SEQ ID NO: 1096 - DNA, 254 bp, Unknown
  Kingdom: Bacteria, Phylum: Proteobacteria, Class: Gammaproteobacteria, Order: Enterobacteriales, Family: Enterobacteriaceae, Genus:
atacggagggtgcaagcgttaatcggaattactgggcgtaaagcgcacgcaggcggtctgtcaagtcggatgtgaaatccccgggctcaacccgggaactgcattcgaaactggcaggctagagtctcgtagaggggggtagaattccaggtgtagcggtgaaatgcgtagagatctggaggaataccggtggcgaaggcggccccctggacgaagactgacgctcaggtgcgaaagcgtggggagcaaacagg

SEQ ID NO: 1097 - DNA, 254 bp, Unknown
  Kingdom: Bacteria, Phylum: Proteobacteria, Class: Gammaproteobacteria, Order: Enterobacteriales, Family: Enterobacteriaceae, Genus:
atacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtggaattccaggtgtagcggtgaaatgcgtagagatctggaggaataccggtggcgaaggcggccccctggacaaagactgacgctcaggtgcgaaagcgtggggagcaaacagg

SEQ ID NO: 1098 - DNA, 254 bp, Unknown
  Kingdom: Bacteria, Phylum: Proteobacteria, Class: Gammaproteobacteria, Order: Enterobacteriales, Family: Enterobacteriaceae, Genus:
atacggagggtgcaagcgttaatcggaattactgggcgtaaagcgcacgcaggcggtctgtcaagtcggatgtgaaatccccgggctcaacctgggaactgcatccgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacagg

SEQ ID NO: 1099 - DNA, 254 bp, Unknown
  Kingdom: Bacteria, Phylum: Proteobacteria, Class: Gammaproteobacteria, Order: Enterobacteriales, Family: Enterobacteriaceae, Genus:
atacggagggtgcaagcgttaatcggaattactgggcgtaaagcgcacgcaggcggtctgtcaagtcggatgtgaaatccccgggctcaacctgggaactgcattcgaaactgacaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacagg

SEQ ID NO: 1100 - DNA, 254 bp, Unknown
  Kingdom: Bacteria, Phylum: Proteobacteria, Class: Gammaproteobacteria, Order: Enterobacteriales, Family: Enterobacteriaceae, Genus:
atacggagggtgcaagcgttaatcggaattactgggcgtaaagcgcacgcaggcggtttgttaagtcagatgtgaaatccccgggctcaacctgggaactgcatttgaaactggcaagcttgagtcttgtagaggggggtagaattccaggtgtagcggtgaaatgcgtagagatctggaggaataccggtggcgaaggcggccccctggacaaagactgacgctcaggtgcgaaagcgtggggagcaaacagg

SEQ ID NO: 1101 - DNA, 254 bp, Unknown
  Kingdom: Bacteria, Phylum: Proteobacteria, Class: Gammaproteobacteria, Order: Enterobacteriales, Family: Enterobacteriaceae, Genus:
atacggagggtgcaagcgttaatcggaattactgggcgtaaagcgcacgcaggcggtttgttaagtcagatgtgaaatccccgggctcaacctgggaactgcatttgaaactggcaagcttgagtctcgtagaggggggtagaattccaggtgtagcggtgaaatgcgtagagatctggaggaataccggtggcgaaggcggccccctggacgaagactgacgctcaggtgcgaaagcgtggggagcaaacagg

SEQ ID NO: 1102 - DNA, 254 bp, Unknown
  Kingdom: Bacteria, Phylum: Proteobacteria, Class: Gammaproteobacteria, Order: Enterobacteriales, Family: Enterobacteriaceae, Genus:
atacggagggtgcaagcgttaatcggaattactgggcgtaaagcgcacgcaggcggtttgttaagtcagatgtgaaatccccgcgcttaacgtgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacagg

SEQ ID NO: 1103 - DNA, 254 bp, Unknown
  Kingdom: Bacteria, Phylum: Proteobacteria, Class: Gammaproteobacteria, Order: Enterobacteriales, Family: Enterobacteriaceae, Genus:
atacggagggtgcaagcgttaatcggaattactgggcgtaaagcgcacgcaggcggtttgttaagtcagatgtgaaatccccgagcttaacttgggaactgcatttgaaactggcaagctagagtcttgtagaggggggtagaattccaggtgtagcggtgaaatgcgtagagatctggaggaataccggtggcgaaggcggccccctggacaaagactgacgctcaggtgcgaaagcgtggggagcaaacagg

SEQ ID NO: 1104 - DNA, 254 bp, Unknown
  Kingdom: Bacteria, Phylum: Proteobacteria, Class: Gammaproteobacteria, Order: Enterobacteriales, Family: Enterobacteriaceae, Genus:
atacggagggtgcaagcgttaatcggaattactgggcgtaaagcgcacgcaggcggtctgtcaagtcggatgtgaaatccccgggctcaacctgggaactgcatccgaaactggcaggcttgagtctcgtagaggggggtagaattccaggtgtagcggtgaaatgcgtagagatctggaggaataccggtggcgaaggcggccccctggacgaagactgacgctcaggtgcgagagcgtggggagcaaacagg

SEQ ID NO: 1105 - DNA, 254 bp, Unknown
  Kingdom: Bacteria, Phylum: Proteobacteria, Class: Gammaproteobacteria, Order: Enterobacteriales, Family: Enterobacteriaceae, Genus:
atacggagggtgcaagcgttaatcggaattactgggcgtaaagcgcacgcaggcggtctgtcaagtcggatgtgaaatccccgggctcaacctgggaactgcatccgaaactggcaggcttgagtcttgtagaggggggtagaattccaggtgtagcggtgaaatgcgtagagatctggaggaataccggtggcgaaggcggccccctggacaaagactgacgctcaggtgcgaaagcgtggggagcaaacagg

SEQ ID NO: 1106 - DNA, 254 bp, Unknown
  Kingdom: Bacteria, Phylum: Proteobacteria, Class: Gammaproteobacteria, Order: Enterobacteriales, Family: Enterobacteriaceae, Genus:
atacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacagg

SEQ ID NO: 1107 - DNA, 251 bp, Unknown
  Kingdom: Bacteria, Phylum: Proteobacteria, Class: Gammaproteobacteria, Order: Enterobacteriales, Family: Enterobacteriaceae, Genus:
tacggagggtgcaagcgttaatcggaattactgggcgtaaagcgcacgcaggcggtctgtcaagtcagatgtgaaatccccgggcttaacctgggaactgcatttgaaactggcaggctagagtcttgtagaggggggtagaattccaggtgtagcggtgaaatgcgtagagatctggaggaataccggtggcgaaggcggccccctggacaaactgacgctcaggtgcgaaagcgtggggagcaaacagg

SEQ ID NO: 1108 - DNA, 254 bp, Unknown
  Kingdom: Bacteria, Phylum: Proteobacteria, Class: Gammaproteobacteria, Order: Enterobacteriales, Family: Enterobacteriaceae, Genus:
atacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacagg

SEQ ID NO: 1109 - DNA, 254 bp, Unknown
  Kingdom: Bacteria, Phylum: Proteobacteria, Class: Gammaproteobacteria, Order: Enterobacteriales, Family: Enterobacteriaceae, Genus:
atacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacaaagactgacgctcaggtgcgaaagcgtggggagcaaacagg

SEQ ID NO: 1110 - DNA, 254 bp, Unknown
  Kingdom: Bacteria, Phylum: Proteobacteria, Class: Gammaproteobacteria, Order: Enterobacteriales, Family: Enterobacteriaceae, Genus:
atacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgagagcgtggggagcaaacagg

SEQ ID NO: 1111 - DNA, 254 bp, Unknown
  Kingdom: Bacteria, Phylum: Proteobacteria, Class: Gammaproteobacteria, Order: Enterobacteriales, Family: Enterobacteriaceae, Genus:
atacggagggtgcaagcgttaatcggaattactgggcgtaaagcgcacgcaggcggtctgtcaagtcggatgtgaaatccccgggctcaacctgggaactgcattcgaaactggcagactggagtcttgtagaggggggtagaattccaggtgtagcggtgaaatgcgtagagatctggaggaataccggtggcgaaggcggccccctggacaaagactgacgctcaggtgcgaaagcgtggggagcaaacagg

SEQ ID NO: 1112 - DNA, 254 bp, Unknown
  Kingdom: Bacteria, Phylum: Proteobacteria, Class: Gammaproteobacteria, Order: Enterobacteriales, Family: Enterobacteriaceae, Genus:
atacggagggtgcaagcgttaatcggaattactgggcgtaaagcgcacgcaggcggtctgttaagtcagatgtgaaatccccgggcttaacctgggaactgcatttgaaactggcaggcttgagtcttgtagaggggggtagaattccaggtgtagcggtgaaatgcgtagagatctggaggaataccggtggcgaaggcggccccctggacgaagactgacgctcaggtgcgaaagcgtggggagcaaacagg

SEQ ID NO: 1113 - DNA, 254 bp, Unknown
  Kingdom: Bacteria, Phylum: Proteobacteria, Class: Gammaproteobacteria, Order: Enterobacteriales, Family: Enterobacteriaceae, Genus:
atacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaccagg

SEQ ID NO: 1114 - DNA, 251 bp, Unknown
  Kingdom: Bacteria, Phylum: Proteobacteria, Class: Gammaproteobacteria, Order: Legionellales, Family: Coxiellaceae, Genus: Aquicella
tacagagggtgcgagcgttaatcggaattactgggtgtaaagggcgcgtaggcggtatgatgtgtgtgatgtgaaagccccgggcttaacctgggaagtgcatcgcaaactgttgtactagagtatatgagagggtggcggaatttccggtgtagcggtgaaatgcgtagagatcggaaggaacgtcaatggcgaaggcagccacctggcataactgacgctgaggcgcgaaagcgtggggagcgaacagg

SEQ ID NO: 1115 - DNA, 254 bp, Unknown
  Kingdom: Bacteria, Phylum: Proteobacteria, Class: Gammaproteobacteria, Order: Legionellales, Family: Coxiellaceae, Genus: Aquicella
atacagagggtgcgagcgttaatcggagttactgggcgtaaagggcgcgtaggcggtatgatgtgtgtgatgtgaaagccccgggcttaacctgggaagtgcatcgcaaactatcaaactagagtatatgagagggtggcggaatttccggtgtagcggtgaaatgcgtagagatcggaaggaacgtcaatggcgaaggcagccacctggcataatactgacgctgaggcgcgaaagcgtggggagcgaacagg

SEQ ID NO: 1116 - DNA, 254 bp, Unknown
  Kingdom: Bacteria, Phylum: Proteobacteria, Class: Gammaproteobacteria, Order: Legionellales, Family: Coxiellaceae, Genus: Aquicella
atacagagggtgcgagcgttaatcggaattactgggcgtaaagggcgcgtaggtggtttattaagatggatgtgaaatccctgggcttaacctaggaacggcatcgatgactgataagctggagtactgtagagggtagtggaatttccggtgtagcggtgaaatgcgtagagatcggaaggaacaccagtggcgaaggcggctacctggacagatactgacactgaggcgcgagagcgtggggagcaaacagg

SEQ ID NO: 1117 - DNA, 254 bp, Unknown
  Kingdom: Bacteria, Phylum: Proteobacteria, Class: Gammaproteobacteria, Order: Legionellales, Family: Coxiellaceae, Genus: Aquicella
atacagagggtgcaagcgttaatcggagttactgggcgtaaagggcgcgtaggcggttatgtaagtgagatgtgaaatccctgggcttaacctaggaactgcatctcatactgtatagctagagtattgtagagggtagtggaatttccggtgtagcggtgaaatgcgtagagatcggaaggaacaccagtggcgaaggcggctacctggacaaatactgacgctgaggcgcgagagcgtggggagcaaacagg

SEQ ID NO: 1118 - DNA, 254 bp, Unknown
  Kingdom: Bacteria, Phylum: Proteobacteria, Class: Gammaproteobacteria, Order: Legionellales, Family: Coxiellaceae, Genus: Aquicella
atacagagggtgctagcgttaatcggaattactgggcgtaaagggcgcgtaggcggtaagatatgtgtggtgtgaaagccctgggcttaacctaggaagtgcatcgcaaactgtcttgctggagtatatgagagggtggcggaatttccggtgtagcggtgaaatgcgtagagatcggaaggaacgtcgatggcgaaggcagccacctggcataatactgacgctgaggcgcgaaagcgtggggagcgaacagg

SEQ ID NO: 1119 - DNA, 253 bp, Unknown
  Kingdom: Bacteria, Phylum: Proteobacteria, Class: Gammaproteobacteria, Order: Legionellales, Family: Coxiellaceae, Genus:
tacagagggtgcgagcgttaatcggaattactgggcgtaaagggcgcgtaggcggtgtaatgtgagtgatgtgaaagccccgggcttaacctgggaagcgcatcgcagactattagactagagtatatgagagggtggcggaatttccggtgtagcggtgaaatgcgtagagatcggaaggagcgtcgatggcgaaggcagccacctggcataatactgacgctgaggcgcgaaagcgtgggtagcgaacagg

SEQ ID NO: 1120 - DNA, 254 bp, Unknown
  Kingdom: Bacteria, Phylum: Proteobacteria, Class: Gammaproteobacteria, Order: Legionellales, Family: Coxiellaceae, Genus:
atacagagggtgcgagcgttgatcggagttactgggcgtaaagggcgcgtaggcggttatatgagtgtggtgtgaaagccccgggcttaacctgggaagtgcatcgcaaacgatataactggagtagatgagagggtggtggaatttccggtgtagcggtgaaatgcgtagagatcggaaggaacgtcaatggcgaaggcagccacctggcatcatactgacgctgaggcgcgaaagcgtggggagcgaacagg

SEQ ID NO: 1121 - DNA, 254 bp, Unknown
  Kingdom: Bacteria, Phylum: Proteobacteria, Class: Gammaproteobacteria, Order: Legionellales, Family: Coxiellaceae, Genus:
atacagagggtgcgagcgttaatcggagttactgggcgtaaagggcgcgtaggcggttgtataagattgatgtgaaatccctgggcttaacctaggaactgcattgattactgtatgactagagtactgtagagggtagtggaatttccggtgtagcggtgaaatgcgtagagatcggaaggaacaccagtggcgaaggcggctacctggacagatactgacgctgaggcgcgaaagcgtggggagcaaacagg

SEQ ID NO: 1122 - DNA, 253 bp, Unknown
  Kingdom: Bacteria, Phylum: Proteobacteria, Class: Gammaproteobacteria, Order: Legionellales, Family: Coxiellaceae, Genus:
tacagagggtgcaagcgttaatcggagttactgggcgtaaagggcgcgtaggcggtgaattgggtgtggtgtgaaagccccgggcttaacctgggaagtgcatcgcaaactaattgactggagtagatgagagggtggcggaatttccggtgtagcggtgaaatgcgtagagatcggaaggaacgtcaatggcgaaggcagccacctggcatcatactgacgctgaggcgcgagagcgtggggagcgaacagg

SEQ ID NO: 1123 - DNA, 254 bp, Unknown
  Kingdom: Bacteria, Phylum: Proteobacteria, Class: Gammaproteobacteria, Order: Legionellales, Family: Coxiellaceae, Genus:
atacagagggtgcaagcgttaatcggagttactgggcgtaaagggcgcgtaggcggttgtataagtgagatgtgaaatccctgggcttaacctaggaactgcatcttatactgtatgactggagtactgtagagggtagtggaatttccggtgtagcggtgaaatgcgtagagatcggaaggaacaccagtggcgaaggcggctacctggacagatactgacgctgaggcgcgagagcgtggggagcaaacagg

SEQ ID NO: 1124 - DNA, 254 bp, Unknown
  Kingdom: Bacteria, Phylum: Proteobacteria, Class: Gammaproteobacteria, Order: Legionellales, Family: Coxiellaceae, Genus:
atacagagggtgcgagcgttaatcggatttactgggcgtaaagggcgcgtaggcggtgatgtgagtgtgatgtgaaagccccgggcttaacctgggaagtgcatcgcaaacgacatgactggagtagatgagagggtggcggaatttccggtgtagcggtgaaatgcgtagagatcggaaggaacgtcaatggcgaaggcagccacctggcatcatactgacgctgaggcgcgaaagcgtggggagcgaacagg

SEQ ID NO: 1125 - DNA, 254 bp, Unknown
  Kingdom: Bacteria, Phylum: Proteobacteria, Class: Gammaproteobacteria, Order: Legionellales, Family: Coxiellaceae, Genus:
atacagagggtgcaagcgttaatcggatttactgggcgtaaagggcgcgtaggtggtaaagcaagtaagatgtgaaagccctgggcttaacctgggaagtgcatcttaaactgcttaactagagtatggtagagggtagtggaatttccggtgtagcggtgaaatgcgtagagatcggaaggaacgccagtggtgaagacgactacctggaccaatactgacactgaggcgcgaaagcgtggggatcaaacagg

SEQ ID NO: 1126 - DNA, 251 bp, Unknown
  Kingdom: Bacteria, Phylum: Proteobacteria, Class: Gammaproteobacteria, Order: Legionellales, Family: Coxiellaceae, Genus:
tacagagggtgcaagcgttaatcggagttactgggcgtaaagggcgcgtaggcggttatttaagttggatgtgaaatccctgggcttaacctaggaactgcatacaatactgaatgactagagtactgtagagggtagtggaatttccggtgtagcggtgaaatgcgtagagatcggaaggaacaccagtggcgaaggcggctacctggacagactgacgctgaggcgcgagagcgtggggagcaaacagg

SEQ ID NO: 1127 - DNA, 254 bp, Unknown
  Kingdom: Bacteria, Phylum: Proteobacteria, Class: Gammaproteobacteria, Order: Legionellales, Family: Coxiellaceae, Genus:
atacagagggtgcgagcgttaatcggaattactgggcgtaaagggcgcgtaggcggttatttaagttagttgtgaaatccctgggcttaacctaggaactgcaactaatactggatagctggagtgcggtagagggtagtggaatttccggtgtagcggtgaaatgcgtagatatcggaaggaacaccagtggcgaaggcggctacctggactgacactgacgctgaggcgcgagagcgtggggagcaaacagg

SEQ ID NO: 1128 - DNA, 251 bp, Unknown
  Kingdom: Bacteria, Phylum: Proteobacteria, Class: Gammaproteobacteria, Order: Legionellales, Family: Coxiellaceae, Genus:
tacagagggtgcgagcgttaatcggagtaactgggcgtaaagggcgcgtaggcggtttagcgagtgtgatgtgaaagccccgggcttaacctgggaagtgcatcgcaaacggctagactagagtagatgagagggtgatggaatttccggtgtagcggtgaaatgcgtagagatcggaaggaacgtcgatggcgaaggcagtcacctggcatcactgacgctgaggcgcgaaagcgtggggagcaaacagg

SEQ ID NO: 1129 - DNA, 251 bp, Unknown
  Kingdom: Bacteria, Phylum: Proteobacteria, Class: Gammaproteobacteria, Order: Legionellales, Family: Coxiellaceae, Genus:
tacagagggtgcgagcgttaatcggagttactgggcgtaaagggcgcgtaggcggttatttaagtgagatgtgaaatccctgggcttaacctaggaactgcatctcatactggatagctagagtattgtagagggtagtggaatttccggtgtagcggtgaaatgcgtagagatcggaaggaacaccagtggcgaaggcggctacctggacaaactgacgctgaggcgcgaaagcgtggggagcaaacagg

SEQ ID NO: 1130 - DNA, 254 bp, Unknown
  Kingdom: Bacteria, Phylum: Proteobacteria, Class: Gammaproteobacteria, Order: Legionellales, Family: Coxiellaceae, Genus:
atacagagggtgcaagcgttaatcagaatgactgggcgtaaagggcgtgtaggtggttgactaggtttgatgtgaaatccccgggcttaacctgggaattgcgtcgaaaacgggtcgactagagtgagatagagggttgtggaatttccggtgtagcggtgaaatgcgtagatatcggaaagaacatcagtggcgaaggcgacaacctggatcttaactgacactgaggcgcgaaggcgtggggagcaaacagg

SEQ ID NO: 1131 - DNA, 254 bp, Unknown
  Kingdom: Bacteria, Phylum: Proteobacteria, Class: Gammaproteobacteria, Order: Legionellales, Family: Coxiellaceae, Genus:
gtacagagggtgcaagcgttaatcggatttactgggcgtaaagggcgcgtaggtggtggcgtaagtgagatgtggaatccccgggcttaacctgggacgtgcatcttagactgcgtagctagagtgtagtagagggtagtggaatttccggtgtagcggtgaaatgcgtagatatcggaaggaacaccagtggcgaaagcggctacctggactaacactgacactgaggcgcgagagcgtggggagcaaacagg

SEQ ID NO: 1132 - DNA, 254 bp, Unknown
  Kingdom: Bacteria, Phylum: Proteobacteria, Class: Gammaproteobacteria, Order: Legionellales, Family: Legionellaceae, Genus:
atacggagggtgcgagcgttaatcggaattactgggcgtaaagggtgcgtaggtggtttattaagttatctgtgaaatccctgggcttaacctgggcaggtcagataagactggtagactcgagtatgggagagggtagtggaatttccggtgtagcggtgaaatgcgtagagatcggaaggaacaccagtggcgaaggcggctacctggcctaatactgacactgaggcacgaaagcgtggggagcaaacagg

SEQ ID NO: 1133 - DNA, 251 bp, Unknown
  Kingdom: Bacteria, Phylum: Proteobacteria, Class: Gammaproteobacteria, Order: Legionellales, Family:  , Genus:
tacagagggtgcgagcgttaatcggaattactgggcgtaaagggtgcgtaggtggttgaataagttaggtgtgaaattcccgggcttaacctggggactgcgcctgatactgtttagctagagtactgtagagggaagtggaatttccggtgtagcggtgaaatgcgtagatatcggaaggaacaccagtggcgaaagcgactttctggacagactgacactgaggcacgaaagcgtggggagcaaacagg

SEQ ID NO: 1134 - DNA, 254 bp, Unknown
  Kingdom: Bacteria, Phylum: Proteobacteria, Class: Gammaproteobacteria, Order: Oceanospirillales, Family: Halomonadaceae, Genus:
atacggagggtgcgagcgttaatcggaattactgggcgtaaagcgcgcgtaggtggcttgataagccggttgtgaaagccccgggctcaacctgggaacggcatccggaactgtcaagctagagtgcaggagaggaaggtagaattcccggtgtagcggtgaaatgcgtagagatcgggaggaataccagtggcgaaggcggccttctggactgacactgacactgaggtgcgaaagcgtgggtagcaaacagg

SEQ ID NO: 1135 - DNA, 255 bp, Unknown
  Kingdom: Bacteria, Phylum: Proteobacteria, Class: Gammaproteobacteria, Order: Oceanospirillales, Family: Oceanospirillaceae, Genus: Pseudospirillum
atacagagggtgcaagcgttaatcggaattactgggcgtaaagcgcgcgtaggcggctgattaagtcgggtgtgaaagccccgggctcaacctgggaattgcatccgatactgatcggctagagtatgagagagggaggtagaattccacgtgtagcggtgaaatgcgtagatatgtggaggaataccggtggcgaaggcggcctcctggctttaatactgacgctgaggtgcgaaagcgtggggatcaaacagg

SEQ ID NO: 1136 - DNA, 254 bp, Unknown
  Kingdom: Bacteria, Phylum: Proteobacteria, Class: Gammaproteobacteria, Order: Oceanospirillales, Family: Oceanospirillaceae, Genus:
atacagagggtgcaagcgttaatcggaattactgggcgtaaagcgcgcgtaggcggctgtctaagtcgggtgtgaaagccccgggctcaacctgggaactgcattcgatactggacggctagagtatgagagagggaggtagaattccacgtgtagcggtgaaatgcgtagatatgtggaggaataccggtggcgaaggcggcctcctggcttaatactgacgctgaggtgcgaaagcgtggggagcaaacagg

SEQ ID NO: 1137 - DNA, 254 bp, Unknown
  Kingdom: Bacteria, Phylum: Proteobacteria, Class: Gammaproteobacteria, Order: Oceanospirillales, Family: Oceanospirillaceae, Genus:
atacagagggtgcaagcgttaatcggaattactgggcgtaaagcgcgcgtaggcggctgcctaagtcggatgtgaaagccccgggctcaacctgggaactgcattcgatactgggcggctagagtatgagagagggaggtagaattccacgtgtagcggtgaaatgcgtagatatgtggaggaataccggtggcgaaagcggcctcctggttcaatactgacgctgaggtgcgaaagcgtggggagcaaacagg

SEQ ID NO: 1138 - DNA, 254 bp, Unknown
  Kingdom: Bacteria, Phylum: Proteobacteria, Class: Gammaproteobacteria, Order: Oceanospirillales, Family: Oceanospirillaceae, Genus:
atacagagggtgcaagcgttaatcggaattactgggcgtaaagcgcgcgtaggcggctaattaagtcgggtgtgaaagccccgggctcaacctgggaattgcatccgatactgattggctagagtatgagagagggaggtagaattccacgtgtagcggtgaaatgcgtagatatgtggagggataccggtggcgaaggcggcctcctggcttaatactgacgctgaggtgcgaaagcgtggggatcaaacagg

SEQ ID NO: 1139 - DNA, 254 bp, Unknown
  Kingdom: Bacteria, Phylum: Proteobacteria, Class: Gammaproteobacteria, Order: Pasteurellales, Family: Pasteurellaceae, Genus:
atacggagggtgcgagcgttaatcggaataactgggcgtaaagggcacgcaggcggtgacttaagtgaggtgtgaaagccccgggcttaacctgggaattgcatttcatactgggtcgctagagtactttagggaggggtagaattccacgtgtagcggtgaaatgcgtagagatgtggaggaataccgaaggcgaaggcagccccttgggaatgtactgacgctcatgtgcgaaagcgtggggagcaaacagg

SEQ ID NO: 1140 - DNA, 254 bp, Unknown
  Kingdom: Bacteria, Phylum: Proteobacteria, Class: Gammaproteobacteria, Order: Pasteurellales, Family: Pasteurellaceae, Genus:
atacggagggtgcgagcgttaatcggaataactgggcgtaaagggcacgcaggcggttatttaagtgaggtgtgaaagccccgggcttaacctgggaattgcatttcagactgggtaactagagtactttagggaggggtagaattccacgtgtagcggtgaaatgcgtagagatgtggaggaataccgaaggcgaaggcagccccttgggaatgtactgacgctcatgtgcgaaagcgtggggagcaaacagg

SEQ ID NO: 1141 - DNA, 254 bp, Unknown
  Kingdom: Bacteria, Phylum: Proteobacteria, Class: Gammaproteobacteria, Order: Pasteurellales, Family: Pasteurellaceae, Genus:
atacggggggtgcgagcgttaatcggaataactgggcgtaaagggcacgcaggcggtgacttaagtgagatgtgaaagccccgagcttaacttgggaattgcatttcatactgggtcgctagagtactttagggaggggtagaattccacgtgtagcggtgaaatgcgtagagatgtggaggaataccgaaggcgaaggcagccccttgggaatgtactgacgctcatgtgcgaaagcgtggggagcaaacagg

SEQ ID NO: 1142 - DNA, 254 bp, Unknown
  Kingdom: Bacteria, Phylum: Proteobacteria, Class: Gammaproteobacteria, Order: Pasteurellales, Family: Pasteurellaceae, Genus:
atacggagggtgcgagcgttaatcggaataactgggcgtaaagggcacgcaggcggttatttaagtgaggtgtgaaagccctgggcttaacctaggaattgcatttcagactgggtaactagagtactttagggaggggtagaattccacgtgtagcggtgaaatgcgtagagatgtggaggaataccgaaggcgaaggcagccccttgggaatgtactgacgctcatgtgcgaaagcgtggggagcaaacagg

SEQ ID NO: 1143 - DNA, 254 bp, Unknown
  Kingdom: Bacteria, Phylum: Proteobacteria, Class: Gammaproteobacteria, Order: Pseudomonadales, Family: Moraxellaceae, Genus:
atacagagggtgcgagcgttaatcggatttactgggcgtaaagcgtgcgtaggcggctttttaagtcggatgtgaaatccccgagcttaacttgggaattgcattcgatactgggaagctagagtatgggagaggatggtagaattccaggtgtagcggtgaaatgcgtagagatctggaggaataccgatggcgaaggcagccatctggcctaatactgacgctgaggtacgaaagcatggggagcaaacagg

SEQ ID NO: 1144 - DNA, 254 bp, Unknown
  Kingdom: Bacteria, Phylum: Proteobacteria, Class: Gammaproteobacteria, Order: Pseudomonadales, Family: Moraxellaceae, Genus:
atacagagggtgcgagcgttaatcggatttactgggcgtaaagcgtgcgtaggcggctaattgagtcggatgtgaaatccccgagcttaacttgggaattgcattcgatactggttagctagagtgtgggagaggatggtagaattccaggtgtagcggtgaaatgcgtagagatctggaggaataccgatggcgaaggcagccatctggcctaacactgacgctgaggtacgaaagcatggggagcaaacagg

SEQ ID NO: 1145 - DNA, 254 bp, Unknown
  Kingdom: Bacteria, Phylum: Proteobacteria, Class: Gammaproteobacteria, Order: Pseudomonadales, Family: Moraxellaceae, Genus:
atacagagggtgcgagcgttaatcggaattactgggcgtaaagcgcgcgtaggcggcttgttaagtcggatgtgaaatccctgggctcaacctaggcattgcatacgatactggcaagctagagtatgggagaggaaggtagaattccaggtgtagcggtgaaatgcgtagagatctggaggaataccgatggcgaaggcagccttctggcctaatactgacgctgaggtgcgaaagcatggggagcaaacagg

SEQ ID NO: 1146 - DNA, 254 bp, Unknown
  Kingdom: Bacteria, Phylum: Proteobacteria, Class: Gammaproteobacteria, Order: Pseudomonadales, Family: Moraxellaceae, Genus:
atacagagggtgcaagcgttaatcggatttactgggcgtaaagcgcgcgtaggcggctaattaagtcaaatgtgaaatccccgagcttaacttgggaattgcattcgatactggttagctagagtgtgggagaggatggtagaattccaggtgtagcggtgaaatgcgtagagatctggaggaataccgatggcgaaggcagccatctggcctaacactgacgctgaggtgcgaaagcatggggagcaaacagg

SEQ ID NO: 1147 - DNA, 254 bp, Unknown
  Kingdom: Bacteria, Phylum: Proteobacteria, Class: Gammaproteobacteria, Order: Pseudomonadales, Family: Moraxellaceae, Genus:
atacagagggtgcaagcgttaatcggatttactgggcgtaaagcgcgcgtaggtggccaattaagtcaaatgtgaaatccccgagcttaacttgggaattgcattcgatactggttggctagagtatgggagaggatggtagaattccaggtgtagcggtgaaatgcgtagagatctggaggaataccgatggcgaaggcagccatctggcctaatactgacactgaggtgcgaaagcatggggagcaaacagg

SEQ ID NO: 1148 - DNA, 254 bp, Unknown
  Kingdom: Bacteria, Phylum: Proteobacteria, Class: Gammaproteobacteria, Order: Pseudomonadales, Family: Moraxellaceae, Genus:
atacagagggtgcgagcgttaatcggatttactgggcgtaaagcgcgcgtaggtggttaattaagtcaaatgtgaaatccccgagcttaacttgggaattgcattcgatactggttagctagagtatgggagaggatggtagaattccaggtgtagcggtgaaatgcgtagagatctggaggaataccgatggcgaaggcagccatctggcctaatactgacactgaggtgcgaaagcatggggagcaaacagg

SEQ ID NO: 1149 - DNA, 253 bp, Unknown
  Kingdom: Bacteria, Phylum: Proteobacteria, Class: Gammaproteobacteria, Order: Pseudomonadales, Family: Moraxellaceae, Genus:
atacggagggtgcaagcgttaatcggaattactgggcgtaaagcgcgcgtaggcggctgagtaagtcgattgtgaaatccccgggctcaacctgggaattgcagtcgagactgctcggctagagtgtgggagagggtggtggaattcccggtgtagcggtgaaatgcgtagatatcgggaggaacatcagtggcgaaagcgaccgcctggcccaacactgacgctgagtgcgaaagcgtgggtagcaaacagg

SEQ ID NO: 1150 - DNA, 254 bp, Unknown
  Kingdom: Bacteria, Phylum: Proteobacteria, Class: Gammaproteobacteria, Order: Pseudomonadales, Family: Moraxellaceae, Genus:
atacagagggtgcaagcgttaatcggatttactgggcgtaaagcgcgcgtaggcggccaattaagtcaaatgtgaaatccccgagcttaacttgggaattgcattcgatactggttggctagagtgtgggagaggatggtagaattccaggtgtagcggtgaaatgcgtagagatctggaggaataccgatggcgaaggcagccatctggcctaacactgacgctgaggtgcgaaagcatggggagcaaacagg

SEQ ID NO: 1151 - DNA, 254 bp, Unknown
  Kingdom: Bacteria, Phylum: Proteobacteria, Class: Gammaproteobacteria, Order: Pseudomonadales, Family: Moraxellaceae, Genus:
atacagagggtgcgagcgttaatcggatttactgggcgtaaagcgtgcgtaggcggccaattaagtcaaatgtgaaatccccgagcttaacttgggaattgcattcgatactggttggctagagtatgggagaggatggtagaattccaggtgtagcggtgaaatgcgtagagatctggaggaataccgatggcgaaggcagccatctggcctaatactgacgctgaggtacgaaagcatggggagcaaacagg

SEQ ID NO: 1152 - DNA, 254 bp, Unknown
  Kingdom: Bacteria, Phylum: Proteobacteria, Class: Gammaproteobacteria, Order: Pseudomonadales, Family: Moraxellaceae, Genus:
atacagagggtgcgagcgttaatcggatttactgggcgtaaagcgtgcgtaggcggctttttaagtcggatgtgaaatccctgagcttaacttaggaattgcattcgatactgggaagctagagtatgggagaggatggtagaattccaggtgtagcggtgaaatgcgtagagatctggaggaataccgatggcgaaggcagccatctggcctaatactgacgctgaggtacgaaagcatggggagcaaacagg

SEQ ID NO: 1153 - DNA, 255 bp, Unknown
  Kingdom: Bacteria, Phylum: Proteobacteria, Class: Gammaproteobacteria, Order: Pseudomonadales, Family: Moraxellaceae, Genus:
atacagagggtgcgagcgttaatcggaattactgggcgtaaagcgagtgtaggtggctcattaagtcacatgtgaaatccccgggcttaacctgggaactgcatgtgatactggtggtgctagaatatgtgagagggaagtagaattccaggtgtagcggtgaaatgcgtagagatctggaggaataccgatggcgaaggcagcttcctggcataatattgacactgagattcgaaagcgtgggtagcaaacagg

SEQ ID NO: 1154 - DNA, 251 bp, Unknown
  Kingdom: Bacteria, Phylum: Proteobacteria, Class: Gammaproteobacteria, Order: Pseudomonadales, Family: Pseudomonadaceae, Genus:
tacagagggtgcaagcgttaatcggaattactgggcgtaaagcgcgcgtaggtggtttgccaagttgaatgtgaaatccccgggctcaacctgggaactgcatccaaaactggcaggctagagtatggtagagggtggtggaatttcctgtgtagcggtgaaatgcgtagatataggaaggaacatcagtggcgaaggcgaccacctggactgactgacactgaggtgcgaaagcgtggggagcaaacagg

SEQ ID NO: 1155 - DNA, 254 bp, Unknown
  Kingdom: Bacteria, Phylum: Proteobacteria, Class: Gammaproteobacteria, Order: Pseudomonadales, Family: Pseudomonadaceae, Genus:
atacagagggtgcaagcgttaatcggaattactgggcgtaaggcgcgcgtaggtggtttgttaagttggatgtgaaagccccgggctcaacctgggaactgcatccaaaactggcaagctagagtacggtagagggtggtggaatttcctgtgtagcggtgaaatgcgtagatataggaaggaacaccagtggcgaaggcgaccacctggactgatactgacactgaggtgcgaaagcgtggggagcaaacagg

SEQ ID NO: 1156 - DNA, 254 bp, Unknown
  Kingdom: Bacteria, Phylum: Proteobacteria, Class: Gammaproteobacteria, Order: Pseudomonadales, Family: Pseudomonadaceae, Genus:
atacgaagggtgcaagcgttaatcggaattactgggcgtaaagcgcgcgtaggtggttcagcaagttggatgtgaaatccccgggctcaacctgggaactgcatccaaaactactgagctagagtacggtagagggtggtggaatttcctgtgtagcggtgaaatgcgtagatataggaaggaacaccagtggcgaaggcgaccacctggactgatactgacactgaggtgcgaaagcgtggggagcaaacagg

SEQ ID NO: 1157 - DNA, 254 bp, Unknown
  Kingdom: Bacteria, Phylum: Proteobacteria, Class: Gammaproteobacteria, Order: Pseudomonadales, Family: Pseudomonadaceae, Genus:
atacagagggtgcaagcgttaatcggaattactgggcgtaaagcgcgcgtaggtggtttgttaagttggatgtgaaatccccgggctcaacctgggaactgcattcaaaactgactgactagagtatggtagagggtggtggaatttcctgtgtagcggtgaaatgcgtagatataggaaggaacaccagtggcgaaggcgaccacctggactgatactgacactgaggtgcgaaagcgtggggagcaaacagg

SEQ ID NO: 1158 - DNA, 254 bp, Unknown
  Kingdom: Bacteria, Phylum: Proteobacteria, Class: Gammaproteobacteria, Order: Pseudomonadales, Family: Pseudomonadaceae, Genus:
atacgaagggtgcaagcgttaatcggaattactgggcgtaaagcgcgcgtaggtggcttgataagttggatgtgaaatccccgggctcaacctgggaactgcatccaaaactgtctggctagagtgcggtagagggtagtggaatttccagtgtagcggtgaaatgcgtagatattggaaggaacaccagtggcgaaggcgactacctggactgacactgacactgaggtgcgaaagcgtggggagcaaacagg

SEQ ID NO: 1159 - DNA, 254 bp, Unknown
  Kingdom: Bacteria, Phylum: Proteobacteria, Class: Gammaproteobacteria, Order: Pseudomonadales, Family: Pseudomonadaceae, Genus:
atacagagggtgcaagcgttaatcggaattactgggcgtaaagcgcgcgtaggtggtttgttaagttgaatgtgaaatccccgggctcaacctgggaactgcatccaaaactggcaagctagagtatggtagagggtggtggaatttcctgtgtagcggtgaaatgcgtagatataggaaggaacaccagtggcgaaggcgaccacctggactgatactgacactgaggtgcgaaagcgtggggagcaaacagg

SEQ ID NO: 1160 - DNA, 254 bp, Unknown
  Kingdom: Bacteria, Phylum: Proteobacteria, Class: Gammaproteobacteria, Order: Pseudomonadales, Family: Pseudomonadaceae, Genus:
atacagagggtgcaagcgttaatcggaattactgggcgtaaagcgcgcgtaggtggtttgttaagttggatgtgaaatccccgggctcaacctgggaactgcattcaaaactgacgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacagg

SEQ ID NO: 1161 - DNA, 254 bp, Unknown
  Kingdom: Bacteria, Phylum: Proteobacteria, Class: Gammaproteobacteria, Order: Pseudomonadales, Family: Pseudomonadaceae, Genus:
atacagagggtgcaagcgttaatcggaattactgggcgtaaagcgcgcgtaggtggtttgttaagttgaatgtgaaatccccgggctcaacctgggaactgcatccaaaactggcaggctagagtatggtagagggtggtggaatttcctgtgtagcggtgaaatgcgtagatataggaaggaacaccagtggcgaaggcgaccacctggactgatactgacactgaggtgcgaaagcgtggggagcaaacagg

SEQ ID NO: 1162 - DNA, 254 bp, Unknown
  Kingdom: Bacteria, Phylum: Proteobacteria, Class: Gammaproteobacteria, Order: Pseudomonadales, Family: Pseudomonadaceae, Genus:
atacggagggtgcaagcgttaatcggaattactgggcgtaaagcgcacgtaggcggttcgttaagctagctgtgaaatccccgggctcaacctgggaattgcagttagaactggcgagctagagtatggtagaggggtgtggaattccaggtgtagcggtgaaatgcgtagatatctggaggaacatcagtggcgaaggcgacaccctggaccaatactgacgctgaggtgcgaaagcgtggggagcaaacagg

SEQ ID NO: 1163 - DNA, 254 bp, Unknown
  Kingdom: Bacteria, Phylum: Proteobacteria, Class: Gammaproteobacteria, Order: Pseudomonadales, Family: Pseudomonadaceae, Genus:
atacagagggtgcaagcgttaatcggaattactgggcgtaaagcgcgcgtaggtggtttgttaagttggatgtgaaagccccgggctcaacctgggaactgcatccaaaactggcaggctagagtacggtagagggtggtggaatttcctgtgtagcggtgaaatgcgtagatataggaaggaacaccagtggcgaaggcgaccacctggactgatactgacactgaggtgcgaaagcgtggggagcaaacagg

SEQ ID NO: 1164 - DNA, 254 bp, Unknown
  Kingdom: Bacteria, Phylum: Proteobacteria, Class: Gammaproteobacteria, Order: Pseudomonadales, Family: Pseudomonadaceae, Genus:
atacagagggtgcaagcgttaatcggaattactgggcgtaaagcgcgcgtaggtggttcgttaagttggatgtgaaagccccgggctcaacctgggaactgcatccaaaactggcgagctagagtagggcagagggtggtggaatttcctgtgtagcggtgaaatgcgtagatataggaaggaacaccagtggcgaaggcgaccacctgggctcatactgacactgaggtgcgaaagcgtggggagcaaacagg

SEQ ID NO: 1165 - DNA, 254 bp, Unknown
  Kingdom: Bacteria, Phylum: Proteobacteria, Class: Gammaproteobacteria, Order: Pseudomonadales, Family: Pseudomonadaceae, Genus:
atacagagggtgcaagcgttaatcggaattactgggcgtaaagcgcgcgtaggtggttcgttaagttggatgtgaaagccccgggctcaacctgggaactgcatccaaaactggcgagctagagtacggtagagggtggtggaatttcctgtgtagcggtgaaatgcgtagatataggaaggaacaccagtggcgaaggcgaccacctggactgatactgacactgaggtgcgaaagcgtggggagcaaacagg

SEQ ID NO: 1166 - DNA, 254 bp, Unknown
  Kingdom: Bacteria, Phylum: Proteobacteria, Class: Gammaproteobacteria, Order: Pseudomonadales, Family: Pseudomonadaceae, Genus:
atacgaagggtgcaagcgttaatcggaattactgggcgtaaagcgcgcgtaggtggttcgttaagttggatgtgaaagccccgggctcaacctgggaactgcatccaaaactggcgagctagagtatggcagagggtggtggaatttcctgtgtagcggtgaaatgcgtagatataggaaggaacaccagtggcgaaggcgaccacctgggctaatactgacactgaggtgcgaaagcgtggggagcaaacagg

SEQ ID NO: 1167 - DNA, 254 bp, Unknown
  Kingdom: Bacteria, Phylum: Proteobacteria, Class: Gammaproteobacteria, Order: Pseudomonadales, Family: Pseudomonadaceae, Genus:
atacagagggtgcaagcgttaatcggaattactgggcgtaaagcgcgcgtaggtggttcgttaagttggatgtgaaatccccgggctcaacctgggaactgcattcaaaactgtcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacagg

SEQ ID NO: 1168 - DNA, 254 bp, Unknown
  Kingdom: Bacteria, Phylum: Proteobacteria, Class: Gammaproteobacteria, Order: Pseudomonadales, Family: Pseudomonadaceae, Genus:
atacggagggtgcgagcgttaatcggaattactgggcgtaaagcgcgcgtaggtggttcgttaagttggatgtgaaagccccgggctcaacctgggaactgcatccaaaactggcgagctagagtacggtagagggtagtggaatttcctgtgtagcggtgaaatgcgtagatataggaaggaacaccagtggcgaaggcgactacctggactgatactgacactgaggtgcgaaagcgtggggagcaaacagg

SEQ ID NO: 1169 - DNA, 254 bp, Unknown
  Kingdom: Bacteria, Phylum: Proteobacteria, Class: Gammaproteobacteria, Order: Pseudomonadales, Family: Pseudomonadaceae, Genus:
atacagagggtgcaagcgttaatcggaattactgggcgtaaagcgcgcgtaggtggttcgttaagttggatgtgaaagccccgggctcaacctgggaactgcatccaaaactggcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacagg

SEQ ID NO: 1170 - DNA, 251 bp, Unknown
  Kingdom: Bacteria, Phylum: Proteobacteria, Class: Gammaproteobacteria, Order: Pseudomonadales, Family: Pseudomonadaceae, Genus:
tacagagggtgcaagcgttaatcggaattactgggcgtaaagcgcgcgtaggcggtttgttaagttgaatgtgaaatccccgggctcaacctgggaactgcatccaaaactggcaagctagagtatggtagagggtggtggaatttcctgtgtagcggtgaaatgcgtagatataggaaggaacatcagtggcgaaggcgaccacctggaccaactgacgctgaggtgcgaaagcgtggggagcaaacagg

SEQ ID NO: 1171 - DNA, 254 bp, Unknown
  Kingdom: Bacteria, Phylum: Proteobacteria, Class: Gammaproteobacteria, Order: Pseudomonadales, Family: Pseudomonadaceae, Genus:
atacagagggtgcaagcgttaatcggaattactgggcgtaaagcgcgcgtaggtggtttgttaagttggatgtgaaatccccgggctcaacctgggaactgcattcaaaactgactgactagagtgtggtagagggtggtggaatttcctgtgtagcggtgaaatgcgtagatataggaaggaacaccagtggcgaaggcgaccacctggaccaacactgacactgaggtgcgaaagcgtggggagcaaacagg

SEQ ID NO: 1172 - DNA, 254 bp, Unknown
  Kingdom: Bacteria, Phylum: Proteobacteria, Class: Gammaproteobacteria, Order: Pseudomonadales, Family: Pseudomonadaceae, Genus:
atacagagggtgcaagcgttaatcggaattactgggcgtaaagcgcgcgtaggtggttcgttaagttggatgtgaaagccccgggctcaacctgggaactgcattcaaaactgtcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacagg

SEQ ID NO: 1173 - DNA, 254 bp, Unknown
  Kingdom: Bacteria, Phylum: Proteobacteria, Class: Gammaproteobacteria, Order: Pseudomonadales, Family: Pseudomonadaceae, Genus:
atacagagggtgcaagcgttaatcggaattactgggcgtaaagcgcgcgtaggtggttggttaagttggatgtgaaagccccgggctcaacctgggaactgcatccaaaactggccagctagagtagggcagagggtggtggaatttcctgtgtagcggtgaaatgcgtagatataggaaggaacaccagtggcgaaggcgaccacctgggctcatactgacactgaggtgcgaaagcgtggggagcaaacagg

SEQ ID NO: 1174 - DNA, 253 bp, Unknown
  Kingdom: Bacteria, Phylum: Proteobacteria, Class: Gammaproteobacteria, Order: Pseudomonadales, Family: Pseudomonadaceae, Genus:
tacggagggtgcaagcgttaatcggaattactgggcgtaaagcgcgcgtaggtggtttgccaagttgaatgtgaaatccccgggctcaacctgggaactgcatccaaaactggcaggctagagtatggtagagggtggtggaatttcctgtgtagcggtgaaatgcgtagatataggaaggaacatcagtggcgaaggcgaccacctggactgatactgacactgaggtgcgaaagcgtggggagcaaacagg

SEQ ID NO: 1175 - DNA, 254 bp, Unknown
  Kingdom: Bacteria, Phylum: Proteobacteria, Class: Gammaproteobacteria, Order: Pseudomonadales, Family: Pseudomonadaceae, Genus:
atacagagggtgcaagcgttaatcggaattactgggcgtaaagcgcgcgtaggtggtttgttaagttgaatgtgaaatccccgggctcaacctgggaactgcatccaaaactggcaagctagagtagggcagagggtggtggaatttcctgtgtagcggtgaaatgcgtagatataggaaggaacaccagtggcgaaggcgaccacctgggctcatactgacactgaggtgcgaaagcgtggggagcaaacagg

SEQ ID NO: 1176 - DNA, 254 bp, Unknown
  Kingdom: Bacteria, Phylum: Proteobacteria, Class: Gammaproteobacteria, Order: Pseudomonadales, Family: Pseudomonadaceae, Genus:
atacggagggtgcaagcgttaatcggaattactgggcgtaaagcgcacgtaggtggttcgctaagtcagctgtgaaatccccgggctcaacctgggacttgcagttgaaactggtgagctagagtagggtagaggggtgtggaattccaggtgtagcggtgaaatgcgtagatatctggaggaacatcagtggcgaaggcgacaccctggactcatactgacactgaggtgcgaaagcgtggggagcaaacagg

SEQ ID NO: 1177 - DNA, 254 bp, Unknown
  Kingdom: Bacteria, Phylum: Proteobacteria, Class: Gammaproteobacteria, Order: Pseudomonadales, Family: Pseudomonadaceae, Genus:
atacgaagggtgcaagcgttaatcggaattactgggcgtaaagcgcgcgtaggtggttcgttaagttggatgtgaaagccccgggctcaacctgggaactgcatccaaaactggcgagctagagtacggtagagggtggtggaatttcctgtgtagcggtgaaatgcgtagatataggaaggaacaccagtggcgaaggcgaccacctggactgatactgacactgaggtgcgaaagcgtggggagcaaacagg

SEQ ID NO: 1178 - DNA, 254 bp, Unknown
  Kingdom: Bacteria, Phylum: Proteobacteria, Class: Gammaproteobacteria, Order: Pseudomonadales, Family: Pseudomonadaceae, Genus:
atacggagggtgcaagcgttaatcggaattactgggcgtaaagcgcgcgtaggtggtttgttaagttggatgtgaaatccccgggctcaacctgggaactgcattcaaaactgactgactagagtatggtagagggtggtggaatttcctgtgtagcggtgaaatgcgtagatataggaaggaacaccagtggcgaaggcgaccacctggactgatactgacactgaggtgcgaaagcgtggggagcaaacagg

SEQ ID NO: 1179 - DNA, 254 bp, Unknown
  Kingdom: Bacteria, Phylum: Proteobacteria, Class: Gammaproteobacteria, Order: Pseudomonadales, Family: Pseudomonadaceae, Genus:
atacagagggtgcaagcgttaatcggaattactgggcgtaaagcgcgcgtaggtggtttgttaagttggatgtgaaagccccgggctcaacctgggaactgcatccaaaactggcaagctagagtatggtagagggtggtggaatttcctgtgtagcggtgaaatgcgtagatataggaaggaacaccagtggcgaaggcgaccacctggactgatactgacactgaggtgcgaaagcgtggggagcaaacagg

SEQ ID NO: 1180 - DNA, 254 bp, Unknown
  Kingdom: Bacteria, Phylum: Proteobacteria, Class: Gammaproteobacteria, Order: Pseudomonadales, Family: Pseudomonadaceae, Genus:
atacagagggtgcaagcgttaatcggaattactgggcgtaaagcgcgcgtaggtggttcgttaagttggatgtgaaatccccgggctcaacctgggaactgcattcaaaactgacgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacagg

SEQ ID NO: 1181 - DNA, 254 bp, Unknown
  Kingdom: Bacteria, Phylum: Proteobacteria, Class: Gammaproteobacteria, Order: Pseudomonadales, Family: Pseudomonadaceae, Genus:
atacagagggtgcaagcgttaatcggaattactgggcgtaaagcgcgcgtaggtggttagttaagttggatgtgaaatccccgggctcaacctgggaactgcattcaaaactgactgactagagtatggtagagggtggtggaatttcctgtgtagcggtgaaatgcgtagatataggaaggaacaccagtggcgaaggcgaccacctggactgatactgacactgaggtgcgaaagcgtggggagcaaacagg

SEQ ID NO: 1182 - DNA, 254 bp, Unknown
  Kingdom: Bacteria, Phylum: Proteobacteria, Class: Gammaproteobacteria, Order: Pseudomonadales, Family: Pseudomonadaceae, Genus:
atacagagggtgcaagcgttaatcggaattactgggcgtaaagcgcgcgtaggcggtttgtcaagtcgaatgtgaaatccccgggctcaacctgggaactgcatccgaaactggcaagctagagtatggtagagggtggtggaatttcctgtgtagcggtgaaatgcgtagatataggaaggaacatcagtggcgaaggcgaccacctggaccaatactgacgctgaggtgcgaaagcgtggggagcaaacagg

SEQ ID NO: 1183 - DNA, 254 bp, Unknown
  Kingdom: Bacteria, Phylum: Proteobacteria, Class: Gammaproteobacteria, Order: Pseudomonadales, Family: Pseudomonadaceae, Genus:
atacagagggtgcaagcgttaatcggaattactgggcgtaaagcgcgcgtaggtggtttgttaagtcggatgtgaaatccccgggctcaacctgggaactgcatccgaaactggcaagctagagtatggtagagggtagtggaatttcctgtgtagcggtgaaatgcgtagatataggaaggaacaccagtggcgaaggcgactacctggactgatactgacactgaggtgcgaaagcgtggggagcaaacagg

SEQ ID NO: 1184 - DNA, 251 bp, Unknown
  Kingdom: Bacteria, Phylum: Proteobacteria, Class: Gammaproteobacteria, Order: Pseudomonadales, Family: Pseudomonadaceae, Genus:
tacgaagggtgcaagcgttaatcggaattactgggcgtaaagcgcgcgtaggtggcttgataagttggatgtgaaatccccgggctcaacctgggaactgcatccaaaactgtctggctagagtgtggtagagggtagtggaatttccagtgtagcggtgaaatgcgtagatattggaaggaacaccagtggcgaaggcgactacctggactaactgacactgaggtgcgaaagcgtggggagcaaacagg

SEQ ID NO: 1185 - DNA, 254 bp, Unknown
  Kingdom: Bacteria, Phylum: Proteobacteria, Class: Gammaproteobacteria, Order: Pseudomonadales, Family: Pseudomonadaceae, Genus:
atacagagggtgcaagcgttaatcggaattactgggcgtaaagcgcgcgtaggtggtttgttaagttggatgtgaaatccccgggctcaacctgggaactgcattcaaaactgactgactagagtatggtagagggtggtggaatttcctgtgtagcggtgaaatgcgtagatataggaaggaacaccagtggcgaaggcgaccacctggactaatactgacactgaggtgcgaaagcgtggggagcaaacagg

SEQ ID NO: 1186 - DNA, 254 bp, Unknown
  Kingdom: Bacteria, Phylum: Proteobacteria, Class: Gammaproteobacteria, Order: Pseudomonadales, Family: Pseudomonadaceae, Genus:
atacagagggtgcaagcgttaatcggaattactgggcgtaaagcgcgcgtaggtggtttgttaagttggatgtgaaatccccgggctcaacctgggaactgcattcaaaactgacaagctagagtatggtagagggtggtggaatttcctgtgtagcggtgaaatgcgtagatataggaaggaacaccagtggcgaaggcgaccacctggactgatactgacactgaggtgcgaaagcgtggggagcaaacagg

SEQ ID NO: 1187 - DNA, 254 bp, Unknown
  Kingdom: Bacteria, Phylum: Proteobacteria, Class: Gammaproteobacteria, Order: Pseudomonadales, Family: Pseudomonadaceae, Genus:
atacggagggtgcaagcgttaatcggaattactgggcgtaaagcgcacgtaggtggtttgttaagccagctgtgaaatccccgggctcaacctgggcactgcagttggaactggcaagctagagtagggtagaggggtgtggaattccaggtgtagcggtgaaatgcgtagatatctggaggaacatcagtggcgaaggcgacaccctggactcatactgacactgaggtgcgaaagcgtggggagcaaacagg

SEQ ID NO: 1188 - DNA, 254 bp, Unknown
  Kingdom: Bacteria, Phylum: Proteobacteria, Class: Gammaproteobacteria, Order: Pseudomonadales, Family: Pseudomonadaceae, Genus:
atacagagggtgcaagcgttaatcggaattactgggcgtaaagcgcgcgtaggtggtttgttaagttggatgtgaaatccccgggctcaacctgggaactgcatccaaaactggcaagctagagtatggtagagggtggtggaatttcctgtgtagcggtgaaatgcgtagatataggaaggaacaccagtggcgaaggcgaccacctggactgatactgacactgaggtgcgaaagcgtggggagcaaacagg

SEQ ID NO: 1189 - DNA, 254 bp, Unknown
  Kingdom: Bacteria, Phylum: Proteobacteria, Class: Gammaproteobacteria, Order: Pseudomonadales, Family: Pseudomonadaceae, Genus:
atacagagggtgcaagcgttaatcggaattactgggcgtaaagcgcgcgtaggtggtttgttaagttgaatgtgaaatccccgggctcaacctgggaactgcatccaaaactggcaagctagagtatggtagagggtagtggaatttcctgtgtagcggtgaaatgcgtagatataggaaggaacaccagtggcgaaggcgactacctggactgatactgacactgaggtgcgaaagcgtggggagcaaacagg

SEQ ID NO: 1190 - DNA, 254 bp, Unknown
  Kingdom: Bacteria, Phylum: Proteobacteria, Class: Gammaproteobacteria, Order: Pseudomonadales, Family: Pseudomonadaceae, Genus:
atacagagggtgcaagcgttaatcggaattactgggcgtaaagcgcgcgtaggtggttcgttaagttggatgtgaaatccccgggctcaacctgggaactgcatccaaaactggcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacagg

SEQ ID NO: 1191 - DNA, 255 bp, Unknown
  Kingdom: Bacteria, Phylum: Proteobacteria, Class: Gammaproteobacteria, Order: Pseudomonadales, Family: Pseudomonadaceae, Genus:
  misc_feature (86)..(86): n is a, c, g, or t
atacgaagggtgcaagcgttaatcggaattactgggcgtaaagcgcgcgtaggtggcttgataagttggatgtgaaatccccgggnctcaacctgggaactgcatccaaaactgtctggctagagtgtggtagagggtagtggaatttccagtgtagcggtgaaatgcgtagatattggaaggaacaccagtggcgaaggcgactacctggactaacactgacactgaggtgcgaaagcgtggggagcaaacagg

SEQ ID NO: 1192 - DNA, 254 bp, Unknown
  Kingdom: Bacteria, Phylum: Proteobacteria, Class: Gammaproteobacteria, Order: Pseudomonadales, Family: Pseudomonadaceae, Genus:
atacagagggtgcaagcgttaatcggaattactgggcgtaaagcgcgcgtaggtggttcggtaagttgaatgtgaaatccccgggctcaacctgggaactgcatccaaaactgccgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacagg

SEQ ID NO: 1193 - DNA, 254 bp, Unknown
  Kingdom: Bacteria, Phylum: Proteobacteria, Class: Gammaproteobacteria, Order: Pseudomonadales, Family: Pseudomonadaceae, Genus:
atacagagggtgcaagcgttaatcggaattactgggcgtaaagcgcgcgtaggtggtttgttaagttggatgtgaaagccccgggctcaacctgggaactgcatccaaaactggcaagctagagtacagtagagggtggtggaatttcctgtgtagcggtgaaatgcgtagatataggaaggaacaccagtggcgaaggcgaccacctggactgatactgacactgaggtgcgaaagcgtggggagcaaacagg

SEQ ID NO: 1194 - DNA, 252 bp, Unknown
  Kingdom: Bacteria, Phylum: Proteobacteria, Class: Gammaproteobacteria, Order: Pseudomonadales, Family: Pseudomonadaceae, Genus:
atacggagggtgcaagcgttaatcggaattactgggcgtaaagcgcgcgtaggtggtttgttaagttggatgtgaaagccccgggctcaacctgggaactgcattcaaaactgacaagctagagtatggtagagggtggtggaatttcctgtgtagcggtgaaatgcgtagatataggaaggaacaccagtggcgaaggcgaccacctgactgatactgacactgaggtgcgaaagcgtggggagcaaacag

SEQ ID NO: 1195 - DNA, 254 bp, Unknown
  Kingdom: Bacteria, Phylum: Proteobacteria, Class: Gammaproteobacteria, Order: Pseudomonadales, Family: Pseudomonadaceae, Genus:
atacggagggtgcaagcgttaatcggaattactgggcgtaaagcgcacgtaggtggtttgttaagctagctgtgaaatccccgggctcaacctgggcactgcagttagaactggcaagctagagtagggtagaggggtgtggaattccaggtgtagcggtgaaatgcgtagatatctggaggaacatcagtggcgaaggcgacaccctggactcatactgacactgaggtgcgaaagcgtggggagcaaacagg

SEQ ID NO: 1196 - DNA, 254 bp, Unknown
  Kingdom: Bacteria, Phylum: Proteobacteria, Class: Gammaproteobacteria, Order: Pseudomonadales, Family: Pseudomonadaceae, Genus:
atacggagggtgcaagcgttaatcggaattactgggcgtaaagcgcacgtaggtggtttgctaagtcagctgtgaaatccccgggctcaacctgggcactgcagttgaaactggcaagctagagtagggtagaggggtgtggaattccaggtgtagcggtgaaatgcgtagatatctggaggaacatcagtggcgaaggcgacaccctggactcatactgacactgaggtgcgaaagcgtggggagcaaacagg

SEQ ID NO: 1197 - DNA, 254 bp, Unknown
  Kingdom: Bacteria, Phylum: Proteobacteria, Class: Gammaproteobacteria, Order: Pseudomonadales, Family: Pseudomonadaceae, Genus:
atacagagggtgcaagcgttaatcggaattactgggcgtaaagcgcgcgtaggtggtttgttaagttggatgtgaaagccccgggctcaacctgggaactgcattcaaaactgacaagctagagtatggtagagggtggtggaatttcctgtgtagcggtgaaatgcgtagatataggaaggaacaccagtggcgaaggcgaccacctggactgatactgacactgaggtgcgaaagcgtggggagcaaacagg

SEQ ID NO: 1198 - DNA, 254 bp, Unknown
  Kingdom: Bacteria, Phylum: Proteobacteria, Class: Gammaproteobacteria, Order: Pseudomonadales, Family: Pseudomonadaceae, Genus:
atacggagggtgcaagcgttaatcggaattactgggcgtaaagcgcgcgtaggtggttcgttaagttggatgtgaaatccccgggctcaacctgggaactgcattcaaaactgtcgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacagg

SEQ ID NO: 1199 - DNA, 254 bp, Unknown
  Kingdom: Bacteria, Phylum: Proteobacteria, Class: Gammaproteobacteria, Order: Pseudomonadales, Family: Pseudomonadaceae, Genus:
atacagagggtgcaagcgttaatcggaattactgggcgtaaagcgcgcgtaggtggtttgttaagttggatgtgaaatccccgggctcaacctgggaactgcatccaaaactggcaagctagagtagggcagagggtggtggaatttcctgtgtagcggtgaaatgcgtagatataggaaggaacaccagtggcgaaggcgaccacctgggctcatactgacactgaggtgcgaaagcgtggggagcaaacagg

SEQ ID NO: 1200 - DNA, 254 bp, Unknown
  Kingdom: Bacteria, Phylum: Proteobacteria, Class: Gammaproteobacteria, Order: Pseudomonadales, Family: Pseudomonadaceae, Genus:
atacagagggtgcaagcgttaatcggaattactgggcgtaaagcgcgcgtaggtggtttgttaagttgaatgtgaaagccccgggctcaacctgggaactgcatccaaaactggcaagctagagtacggtagagggtggtggaatttcctgtgtagcggtgaaatgcgtagatataggaaggaacaccagtggcgaaggcgaccacctggactgatactgacactgaggtgcgaaagcgtggggagcaaacagg

SEQ ID NO: 1201 - DNA, 254 bp, Unknown
  Kingdom: Bacteria, Phylum: Proteobacteria, Class: Gammaproteobacteria, Order: Pseudomonadales, Family: Pseudomonadaceae, Genus:
atacagagggtgcaagcgttaatcggaattactgggcgtaaagcgcgcgtaggtggtttgttaagttggatgtgaaagccccgggctcaacctgggaactgcatccaaaactggcaagctagagtacggtagagggtggtggaatttcctgtgtagcggtgaaatgcgtagatataggaaggaacaccagtggcgaaggcgaccacctggactgatactgacactgaggtgcgaaagcgtggggagcaaacagg

SEQ ID NO: 1202 - DNA, 254 bp, Unknown
  Kingdom: Bacteria, Phylum: Proteobacteria, Class: Gammaproteobacteria, Order: Pseudomonadales, Family: Pseudomonadaceae, Genus:
atacagagggtgcaagcgttaatcggaattactgggcgtaaagcgcgcgtaggtggttcgttaagttggatgtgaaagccccgggctcaacctgggaactgcattcaaaactgacgagctagagtatggtagagggtggtggaatttcctgtgtagcggtgaaatgcgtagatataggaaggaacaccagtggcgaaggcgaccacctggactgatactgacactgaggtgcgaaagcgtggggagcaaacagg

SEQ ID NO: 1203 - DNA, 254 bp, Unknown
  Kingdom: Bacteria, Phylum: Proteobacteria, Class: Gammaproteobacteria, Order: Thiotrichales, Family: Piscirickettsiaceae, Genus:
atacggagggtgcaagcgttaatcggaattactgggcgtaaagcgcgcgtaggcggtttgttaagtcagatgtgaaatccccgggctcaacctgggaatggcatttgagactggcaggctagagtgtggtagaggtgagtggaatttcaggtgtagcggtgaaatgcgtagagatctgaaggaacatcagtggcgaaggcgactcactgggccattactgacgctgaggtgcgaaagcgtgggtagcaaacagg

SEQ ID NO: 1204 - DNA, 251 bp, Unknown
  Kingdom: Bacteria, Phylum: Proteobacteria, Class: Gammaproteobacteria, Order: Xanthomonadales, Family: Sinobacteraceae, Genus:
tacagagggtgcaagcgttaatcggatttactgggcgtaaagcgtgcgtaggcggctagacaagtcggatgtgaaatccccgagcttaacttgggaactgcatccgaaactatctggctagagtgtggtagagggcggtggaattcccggtgtagcggtgaaatgcgtagatatcgggaggaacatcaatggcgaaggcagccgcctgggccaactgacgctgaggtacgaaagcgtggggagcaaacagg

SEQ ID NO: 1205 - DNA, 251 bp, Unknown
  Kingdom: Bacteria, Phylum: Proteobacteria, Class: Gammaproteobacteria, Order: Xanthomonadales, Family: Sinobacteraceae, Genus:
tacagagggtgcgagcgttaatcggaattactgggcgtaaagcgtgcgtagacggtagcgtaagtcgggtgtgaaagccccgggctcaacctgggaattgcattcgagactgctctgctagggtgcggaagagggaagcggaatttccggtgtagcggtgaaatgcgtagatatcggaaggaacaccagtggcgaaagcggcttcctggtccaaccgacgttcaggcacgaaagcgtggggagcaaacagg

SEQ ID NO: 1206 - DNA, 254 bp, Unknown
  Kingdom: Bacteria, Phylum: Proteobacteria, Class: Gammaproteobacteria, Order: Xanthomonadales, Family: Solimonadaceae, Genus: Fontimonas
atacagagggtgcgagcgttaatcggatttactgggcgtaaagcgtgtgtaggcggttattcaagtcggttgtgaaatccccgggctcaacctgggaattgcttccgagactgaatgactagagtacggtagagggcggtggaatttccggtgtagcggtgaaatgcgtagatatcggaaggaacaccaatggcgaaggcagccgcctgggcctgtactgacgctgagacacgaaagcgtggggatcaaacagg

SEQ ID NO: 1207 - DNA, 254 bp, Unknown
  Kingdom: Bacteria, Phylum: Proteobacteria, Class: Gammaproteobacteria, Order: Xanthomonadales, Family: Solimonadaceae, Genus:
atacagagggtgcgagcgttaatcggatttactgggcgtaaagcgtgtgtaggtggctgttcaagtcggttgtgaaatccccgggctcaacctgggaattgcttccgagactgagcggctagagtacggtagagggcggtggaatttccggtgtagcggtgaaatgcgtagatatcggaaggaacaccaatggcgaaggcagccgcctgggcctgtactgacactgagacacgaaagcgtggggatcaaacagg

SEQ ID NO: 1208 - DNA, 254 bp, Unknown
  Kingdom: Bacteria, Phylum: Proteobacteria, Class: Gammaproteobacteria, Order: Xanthomonadales, Family: Xanthomonadaceae, Genus: Stenotrophomonas
atacgaagggtgcaagcgttactcggaattactgggcgtaaagcgtgcgtaggtggttgtttaagtctgttgtgaaagccctgggctcaacctgggaactgcagtggaaactggacaactagagtgtggtagagggtagcggaattcccggtgtagcagtgaaatgcgtagagatcgggaggaacatccatggcgaaggcagctacctggaccaacactgacactgaggcacgaaagcgtggggagcaaacagg

SEQ ID NO: 1209 - DNA, 254 bp, Unknown
  Kingdom: Bacteria, Phylum: Proteobacteria, Class: Gammaproteobacteria, Order: Xanthomonadales, Family: Xanthomonadaceae, Genus:
atacgaagggtgcaagcgttactcggaattactgggcgtaaagcgtgcgtaggtggttgtttaagtctgttgtgaaagccctgggctcaacctgggaattgcagtggatactgggcgactagagtgtggtagagggtagtggaattcccggtgtagcagtgaaatgcgtagagatcgggaggaacatccatggcgaaggcagctacctggaccaacactgacactgaggcacgaaagcgtggggagcaaacagg

SEQ ID NO: 1210 - DNA, 254 bp, Unknown
  Kingdom: Bacteria, Phylum: Proteobacteria, Class: Gammaproteobacteria, Order: Xanthomonadales, Family: Xanthomonadaceae, Genus:
atacgaagggtgcaagcgttactcggaattactgggcgtaaagcgtgcgtaggtggtggtttaagtccgttgtgaaagccctgggctcaacctgggaattgcagtggatactgggtcactagagtgtggtagagggtagcggaattcccggtgtagcagtgaaatgcgtagagatcgggaggaacatctgtggcgaaggcggctacctggaccaacactgacactgaggcacgaaagcgtggggagcaaacagg

SEQ ID NO: 1211 - DNA, 254 bp, Unknown
  Kingdom: Bacteria, Phylum: Proteobacteria, Class: Gammaproteobacteria, Order: Xanthomonadales, Family: Xanthomonadaceae, Genus:
atacgaagggtgcaagcgttactcggaatcactgggcgtaaagcgtgcgtaggcggttcgttaagtctgctgtgaaagccctgggctcaacctgggaactgcagtggatactggcggactagagtgtgatagaggatggtggaattcccggtgtagcggtgaaatgcgtagagatcgggaggaacaccagtggcgaaggcggccatctggatcaacactgacgctgaggcacgaaagcgtggggagcaaacagg

SEQ ID NO: 1212 - DNA, 254 bp, Unknown
  Kingdom: Bacteria, Phylum: Proteobacteria, Class: Gammaproteobacteria, Order: Xanthomonadales, Family: Xanthomonadaceae, Genus:
atacgaagggtgcaagcgttactcggaattactgggcgtaaagcgtgcgtaggtggtcgtttaagtccgttgtgaaagccctgggctcaacctgggaactgcagtggatactgggcgactagagtgtggtagagggtagcggaattcctggtgtagcagtgaaatgcgtagagatcaggaggaacatccatggcgaaggcagctacctggaccaacactgacactgaggcacgaaagcgtggggagcaaacagg

SEQ ID NO: 1213 - DNA, 254 bp, Unknown
  Kingdom: Bacteria, Phylum: Proteobacteria, Class: Gammaproteobacteria, Order: Xanthomonadales, Family: Xanthomonadaceae, Genus:
atacgaagggtgcaagcgttactcggaattactgggcgtaaagcgtgcgtaggtggttgtttaagtctgctgtgaaagccctgggctcaacctgggaattgcagtggatactgggcgactagagtgtggtagaggatagtggaatttccggtgtagcagtgaaatgcgtagagatcggaaggaacatctgtggcgaaggcgactatctgggccaacactgacactgaggcacgaaagcgtggggagcaaacagg

SEQ ID NO: 1214 - DNA, 254 bp, Unknown
  Kingdom: Bacteria, Phylum: Proteobacteria, Class: Gammaproteobacteria, Order: Xanthomonadales, Family: Xanthomonadaceae, Genus:
atacgaagggtgcaagcgttactcggaattactgggcgtaaagcgtgcgtaggtggttgtttaagtctgtcgtgaaagccctgggctcaacctgggaattgcgatggatactggacgactagagtgtggtagagggatgtggaatttccggtgtagcagtgaaatgcgtagagatcggaaggaacatctgtggcgaaggcgacatcctgggccaacactgacactgaggcacgaaagcgtggggagcaaacagg

SEQ ID NO: 1215 - DNA, 251 bp, Unknown
  Kingdom: Bacteria, Phylum: Proteobacteria, Class: Gammaproteobacteria, Order: Xanthomonadales, Family: Xanthomonadaceae, Genus:
tacgaagggtgcaagcgttaatcggaattactgggcgtaaagggtgcgtaggcggttgtttaagtctgtcgtgaaatccccgggctcaacctgggaatggcgatggatactggacagctagagtgtgtcagaggatggtggaattcccggtgtagcggtgaaatgcgtagagatcgggaggaacatcagtggcgaaggcggccatctgggacaactgacgctgaagcacgaaagcgtggggagcaaacagg

SEQ ID NO: 1216 - DNA, 254 bp, Unknown
  Kingdom: Bacteria, Phylum: Proteobacteria, Class: Gammaproteobacteria, Order: Xanthomonadales, Family: Xanthomonadaceae, Genus:
atacgaagggtgcaagcgttactcggaattactgggcgtaaagcgtgcgtaggtggtttgttaagtctgatgtgaaagccctgggctcaacctgggaattgcattggatactggcaggctagagtgcggtagagggtagtggaattcccggtgtagcagtgaaatgcgtagagatcgggaggaacatccgtggcgaaggcgactacctggaccagcactgacactgaggcacgaaagcgtggggagcaaacagg

SEQ ID NO: 1217 - DNA, 254 bp, Unknown
  Kingdom: Bacteria, Phylum: Proteobacteria, Class: Gammaproteobacteria, Order: Xanthomonadales, Family: Xanthomonadaceae, Genus:
atacgaagggtgcaagcgttactcggaattactgggcgtaaagcgtgcgtaggtggttcgttaagtctgccgtgaaagccccgggctcaacctgggaatggcggtggatactggcggactagagtgcggtagagggtggtggaattcccggtgtagcagtgaaatgcgtagagatcgggaggaacatctgtggcgaaggcggccacctggaccagcactgacactgaggcacgaaagcgtggggagcaaacagg

SEQ ID NO: 1218 - DNA, 254 bp, Unknown
  Kingdom: Bacteria, Phylum: Proteobacteria, Class: Gammaproteobacteria, Order: Xanthomonadales, Family: Xanthomonadaceae, Genus:
atacgaagggtgcaagcgttactcggaattactgggcgtaaagcgtgcgtaggtggtttgttaagtctgatgtgaaagccctgggctcaacctgggaactgcattggaaactggcttactagagtgcggtagaggggtgtggaattcccggtgtagcagtgaaatgcgtagatatcgggaggaacatctgtggcgaaggcgacaccctggaccagcactgacactgaggcacgaaagcgtggggagcaaacagg

SEQ ID NO: 1219 - DNA, 254 bp, Unknown
  Kingdom: Bacteria, Phylum: Proteobacteria, Class: Gammaproteobacteria, Order: Xanthomonadales, Family: Xanthomonadaceae, Genus:
atacgaagggtgcaagcgttactcggaattactgggcgtaaagcgtgcgtaggcggttcgttaagtctgtcgtgaaagccctgggctcaacctgggaattgcgatggatactggcgagctagagtacggtagaggatggtggaattcccggtgtagcggtgaaatgcgtagagatcgggaggaacacccgtggcgaaggcggccatctggaccagtactgacgctgaggcacgaaagcgtggggagcaaacagg

SEQ ID NO: 1220 - DNA, 251 bp, Unknown
  Kingdom: Bacteria, Phylum: Proteobacteria, Class: Gammaproteobacteria, Order: Xanthomonadales, Family: Xanthomonadaceae, Genus:
tacgaagggtgcaagcgttactcggaattactgggcgtaaagcgtgcgtaggtggtggtttaagtcagatgtgaaagccctgggctcaacctgggaactgcatttgatactggatcactagagtgcggtagaggatagtggaattcccggtgtagcagtgaaatgcgtagagatcgggaggaacaccagtggcgaaggcgactatctggaccaactgacactgaggcacgaaagcgtggggagcaaacagg

SEQ ID NO: 1221 - DNA, 254 bp, Unknown
  Kingdom: Bacteria, Phylum: Proteobacteria, Class: Gammaproteobacteria, Order: Xanthomonadales, Family: Xanthomonadaceae, Genus:
atacgaagggtgcaagcgttactcggaattactgggcgtaaagcgtgcgtaggtggttgtttaagtccgttgtgaaagccctgggctcaacctgggaattgcagtggatactgggcaactagagtgtggtagaggatggcggaattcccggtgtagcagtgaaatgcgtagagatcgggaggaacatctgtggcgaaggcggccatctggaccaacactgacactgaggcacgaaagcgtggggagcaaacagg

SEQ ID NO: 1222 - DNA, 254 bp, Unknown
  Kingdom: Bacteria, Phylum: Proteobacteria, Class: Gammaproteobacteria, Order: Xanthomonadales, Family: Xanthomonadaceae, Genus:
atacgaagggtgcaagcgttaatcggaattactgggcgtaaagggtgcgtaggcggtttgttaagtctgtcgtgaaatccccgggctcaacctgggaatggcgatggatactggcaagctagagtgtgtcagaggatggtggaatttccggtgtagcggtgaaatgcgtagagatcggaaggaacatcagtggcgaaggcggccatctgggacaacactgacgctgaagcacgaaagcgtggggagcaaacagg

SEQ ID NO: 1223 - DNA, 254 bp, Unknown
  Kingdom: Bacteria, Phylum: Proteobacteria, Class: Gammaproteobacteria, Order: Xanthomonadales, Family: Xanthomonadaceae, Genus:
atacgaagggtgcaagcgttactcggaattactgggcgtaaagcgtgcgtaggtggtttgttaagtctgatgtgaaagccctgggctcaacctgggaattgcattggatactggcaggctagagtgcggtagagggtagtggaattcccggtgtagcagtgaaatgcgtagagatcgggaggaacaccagtggcgaaggcgactacctggaccagcactgacactgaggcacgaaagcgtggggagcaaacagg

SEQ ID NO: 1224 - DNA, 251 bp, Unknown
  Kingdom: Bacteria, Phylum: Proteobacteria, Class: Gammaproteobacteria, Order: Xanthomonadales, Family: Xanthomonadaceae, Genus:
tacgaagggtgcaagcgttactcggaattactgggcgtaaagcgtgcgtaggtggttttttaagtccgttgtgaaagccctgggctcaacctgggaatggcagtggatactggaaagctagagtgcggtagagggtagtggaattcccggtgtagcagtgaaatgcgtagagatcgggaggaacaccagtggcgaaggcggctacctggaccaactgacactgaggcacgaaagcgtggggagcaaacagg

SEQ ID NO: 1225 - DNA, 254 bp, Unknown
  Kingdom: Bacteria, Phylum: Proteobacteria, Class: Gammaproteobacteria, Order: Xanthomonadales, Family: Xanthomonadaceae, Genus:
atacgaagggtgcaagcgttactcggaattactgggcgtaaagcgtgcgtaggtggttgtttaagtctgttgtgaaagccctgggctcaacctgggaactgcagtggaaactggatgactagagtgtggtagagggtagcggaattcccggtgtagcagtgaaatgcgtagagatcgggaggaacatccatggcgaaggcagctacctggaccaacactgacactgaggcacgaaagcgtggggagcaaacagg

SEQ ID NO: 1226 - DNA, 254 bp, Unknown
  Kingdom: Bacteria, Phylum: Proteobacteria, Class: Gammaproteobacteria, Order: Xanthomonadales, Family: Xanthomonadaceae, Genus:
atacgaagggtgcaagcgttactcggaattactgggcgtaaagcgtgcgtaggtggtttgttaagtctgatgtgaaagccctgggctcaacctgggaattgcattggatactggcaggctagagtgcggtagaggatggcggaattcccggtgtagcagtgaaatgcgtagagatcgggaggaacatctgtggcgaaggcggccatctggaccagcactgacactgaggcacgaaagcgtggggagcaaacagg

SEQ ID NO: 1227 - DNA, 254 bp, Unknown
  Kingdom: Bacteria, Phylum: Proteobacteria, Class: Gammaproteobacteria, Order: Xanthomonadales, Family: Xanthomonadaceae, Genus:
atacgaagggtgcaagcgttaatcggaattactgggcgtaaagcgtgcgtaggcggttgtttaagtctgctgtgaaatccccgggctcaacctgggaatggcagtggatactggacagctagagtgtgtcagaggatggtggaattcccggtgtagcggtgaaatgcgtagagatcgggaggaacatcagtggcgaaggcggccatctgggacaacactgacgctgaggcacgaaagcgtggggagcaaacagg

SEQ ID NO: 1228 - DNA, 254 bp, Unknown
  Kingdom: Bacteria, Phylum: Proteobacteria, Class: Gammaproteobacteria, Order: Xanthomonadales, Family: Xanthomonadaceae, Genus:
atacgaagggtgcaagcgttactcggaattactgggcgtaaagcgtgcgtaggtggtttgttaagtctgatgtgaaagccctgggctcaacctgggaatggcattggatactggcaatctagagtgcggtagaggggtgtggaattcccggtgtagcagtgaaatgcgtagatatcgggaggaacatctgtggcgaaggcgacaccctggaccagcactgacactgaggcacgaaagcgtggggagcaaacagg

SEQ ID NO: 1229 - DNA, 254 bp, Unknown
  Kingdom: Bacteria, Phylum: Proteobacteria, Class: Gammaproteobacteria, Order: Xanthomonadales, Family: Xanthomonadaceae, Genus:
atacgaagggtgcaagcgttactcggaattactgggcgtaaagcgtgcgtaggtggttatttaagtccgttgtgaaagccctgggctcaacctgggaactgcagtggatactggatgactagaatgtggtagagggtagcggaattcctggtgtagcagtgaaatgcgtagagatcaggaggaacatccatggcgaaggcagctacctggaccaacattgacactgaggcacgaaagcgtggggagcaaacagg

SEQ ID NO: 1230 - DNA, 254 bp, Unknown
  Kingdom: Bacteria, Phylum: Proteobacteria, Class: Gammaproteobacteria, Order: Xanthomonadales, Family: Xanthomonadaceae, Genus:
atacgaagggtgcaagcgttactcggaattactgggcgtaaagcgtgcgtaggtggtcgtttaagtccgttgtgaaagccctgggctcaacctgggaactgcagtggatactgggcgactagaatgtggtagagggtagcggaattcctggtgtagcagtgaaatgcgtagagatcaggaggaacatccatggcgaaggcagctacctggaccaacattgacactgaggcacgaaagcgtggggagcaaacagg

SEQ ID NO: 1231 - DNA, 254 bp, Unknown
  Kingdom: Bacteria, Phylum: Proteobacteria, Class: Gammaproteobacteria, Order: Xanthomonadales, Family: Xanthomonadaceae, Genus:
atacgaagggtgcaagcgttactcggaattactgggcgtaaagcgtgcgtaggtggttcgttaagtctgatgtgaaagccctgggctcaacctgggaattgcattggatactggcgggctagagtgcggtagaggatggcggaattcccggtgtagcagtgaaatgcgtagagatcgggaggaacatctgtggcgaaggcggccatctggaccagcactgacactgaggcacgaaagcgtggggagcaaacagg

SEQ ID NO: 1232 - DNA, 254 bp, Unknown
  Kingdom: Bacteria, Phylum: Proteobacteria, Class: Gammaproteobacteria, Order: Xanthomonadales, Family: Xanthomonadaceae, Genus:
atacgaagggtgcaagcgttactcggaattactgggcgtaaagcgtgcgtaggtggtgagttaagtctgtcgtgaaagccccgggctcaacctgggaatggcgatggatactggctcgctagagtgcggtagaggagagtggaattcccggtgtagcagtgaaatgcgtagagatcgggaggaacatcagttgcgaaggcggctctctggaccagcactgacactgaggcacgaaagcgtggggagcaaacagg

SEQ ID NO: 1233 - DNA, 254 bp, Unknown
  Kingdom: Bacteria, Phylum: Proteobacteria, Class: Gammaproteobacteria, Order: Xanthomonadales, Family: Xanthomonadaceae, Genus:
atacgaagggtgcaagcgttaatcggaattactgggcgtaaagggtgcgtaggcggttacttaagtctgtcgtgaaatccccgggctcaacctgggaatggcgatggatactgggtggctagagtgtgtcagaggatggtggaattcccggtgtagcggtgaaatgcgtagagatcgggaggaacatcagtggcgaaggcggccatctgggacaacactgacgctgaagcacgaaagcgtggggagcaaacagg

SEQ ID NO: 1234 - DNA, 254 bp, Unknown
  Kingdom: Bacteria, Phylum: Proteobacteria, Class: Gammaproteobacteria, Order: Xanthomonadales, Family: Xanthomonadaceae, Genus:
atacgaagggtgcaagcgttactcggaattactgggcgtaaagcgtgcgtaggtggtggtttaagtctgttgtgaaagccctgggctcaacctgggaattgcagtggatactggatcactagagtgtggtagagggtagcggaattcccggtgtagcagtgaaatgcgtagagatcgggaggaacatccgtggcgaaggcggctacctggaccaacactgacactgaggcacgaaagcgtggggagcaaacagg

SEQ ID NO: 1235 - DNA, 254 bp, Unknown
  Kingdom: Bacteria, Phylum: Proteobacteria, Class: Gammaproteobacteria, Order: Xanthomonadales, Family: Xanthomonadaceae, Genus:
atacgaagggtgcaagcgttactcggaattactgggcgtaaagcgtgcgtaggtggtcgtttaagtccgttgtgaaagccctgggctcaacctgggaactgcagtggatactggacgactagagtgtggtagagggtagcggaattcctggtgtagcagtgaaatgcgtagagatcaggaggaacatccatggcgaaggcagctacctggaccaacactgacactgaggcacgaaagcgtggggagcaaacagg

SEQ ID NO: 1236 - DNA, 254 bp, Unknown
  Kingdom: Bacteria, Phylum: Proteobacteria, Class: Gammaproteobacteria, Order: Xanthomonadales, Family: Xanthomonadaceae, Genus:
atacgaagggtgcaagcgttactcggaattactgggcgtaaagcgtgcgtaggtggttcgttaagtctgatgtgaaagccctgggctcaacctgggaactgcattggatactggcgatctggagtgcggtagagggtggcggaattcccggtgtagcagtgaaatgcgtagatatcgggaggaacatccgtggcgaaggcggccacctggaccagcactgacactgaggcacgaaagcgtggggagcaaacagg

SEQ ID NO: 1237 - DNA, 254 bp, Unknown
  Kingdom: Bacteria, Phylum: Proteobacteria, Class: Gammaproteobacteria, Order: Xanthomonadales, Family: Xanthomonadaceae, Genus:
atacgaagggtgcaagcgttactcggaattactgggcgtaaagcgtgcgtaggtggttgtttaagtctgttgtgaaagccctgggctcaacctgggaattgcagtggatactgggcgactagagtgtggtagaggatagtggaatttccggtgtagcagtgaaatgcgtagagatcggaaggaacatctgtggcgaaggcgactatctgggccaacactgacactgaggcacgaaagcgtggggagcaaacagg

SEQ ID NO: 1238 - DNA, 254 bp, Unknown
  Kingdom: Bacteria, Phylum: Proteobacteria, Class: Gammaproteobacteria, Order: Xanthomonadales, Family: Xanthomonadaceae, Genus:
atacgaagggtgcaagcgttactcggaattactgggcgtaaagcgtgcgtaggtggttcgttaagtctgatgtgaaagccctgggctcaacctgggaatggcattggatactggcgacctagagtgcggtagaggggtgtggaattcccggtgtagcagtgaaatgcgtagatatcgggaggaacatctgtggcgaaggcgacaccctggaccagcactgacactgaggcacgaaagcgtggggagcaaacagg

SEQ ID NO: 1239 - DNA, 254 bp, Unknown
  Kingdom: Bacteria, Phylum: Proteobacteria, Class: Gammaproteobacteria, Order: Xanthomonadales, Family: Xanthomonadaceae, Genus:
atacgaagggtgcaagcgttactcggaattactgggcgtaaagcgtgcgtaggtggttcgttaagtctgatgtgaaagccctgggctcaacctgggaattgcattggatactggcgggctagagtgcggtagaggatggcggaattcccggtgtagcagtgaaatgcgtagagatcgggaggaacatccgtggcgaaggcggccatctggaccagcactgacactgaggcacgaaagcgtggggagcaaacagg

SEQ ID NO: 1240 - DNA, 254 bp, Unknown
  Kingdom: Bacteria, Phylum: Proteobacteria, Class: Gammaproteobacteria, Order: Xanthomonadales, Family: Xanthomonadaceae, Genus:
atacggagggtgcaagcgttaatcggaattactgggcgtaaagcgtgcgtaggcggttcgttaagtctgttgtgaaagccccgggctcaacctgggaatggcaatggatactggcgagctagagtgtgtcagaggatggtggaattcccggtgtagcggtgaaatgcgtagagatcgggaggaacatcagtggcgaaggcggccatctgggacaacactgacgctgaggcacgaaagcgtggggagcaaacagg

SEQ ID NO: 1241 - DNA, 254 bp, Unknown
  Kingdom: Bacteria, Phylum: Proteobacteria, Class: Gammaproteobacteria, Order: Xanthomonadales, Family: Xanthomonadaceae, Genus:
atacgaagggtgcaagcgttactcggaattactgggcgtaaagcgtgcgtaggtggtggtttaagtctgttgtgaaagccctgggctcaacctgggaattgcagtggatactgggtcactagagtgtggtagagggtagcggaattcccggtgtagcagtgaaatgcgtagagatcgggaggaacatccgtggcgaaggcggctacctggaccaacactgacactgaggcacgaaagcgtggggagcaaacagg

SEQ ID NO: 1242 - DNA, 254 bp, Unknown
  Kingdom: Bacteria, Phylum: Proteobacteria, Class: Gammaproteobacteria, Order: Xanthomonadales, Family: Xanthomonadaceae, Genus:
atacgaagggtgcaagcgttactcggaattactgggcgtaaagcgtgcgtaggtggttcgttaagtctgtcgtgaaagccccgggctcaacctgggaatggcgatggatactggcgggctagagtgcggtagaggagagtggaattcccggtgtagcagtgaaatgcgtagagatcgggaggaacatcagttgcgaaggcggctctctggaccagcactgacactgaggcacgaaagcgtggggagcaaacagg

SEQ ID NO: 1243 - DNA, 254 bp, Unknown
  Kingdom: Bacteria, Phylum: Proteobacteria, Class: Gammaproteobacteria, Order: Xanthomonadales, Family: Xanthomonadaceae, Genus:
atacgaagggtgcaagcgttaatcggaattactgggcgtaaagcgtgcgtaggcggtttcttaagtctgctgtgaaatccccgggctcaacctgggaatggcagtggatactgggaagctagagtgtgtcagaggatggtggaattcccggtgtagcggtgaaatgcgtagagatcgggaggaacatcagtggcgaaggcggccatctgggacaacactgacgctgaggcacgaaagcgtggggagcaaacagg

SEQ ID NO: 1244 - DNA, 254 bp, Unknown
  Kingdom: Bacteria, Phylum: Proteobacteria, Class: Gammaproteobacteria, Order: Xanthomonadales, Family: Xanthomonadaceae, Genus:
atacgaagggtgcaagcgttactcggaattactgggcgtaaagcgtgcgtaggtggtggtttaagtctgctgtgaaagccctgggctcaacctgggaattgcagtggatactggatcactagagtgtggtagagggatgcggaatttctggtgtagcagtgaaatgcgtagagatcagaaggaacatccgtggcgaaggcggcatcctgggccaacactgacactgaggcacgaaagcgtggggagcaaacagg

SEQ ID NO: 1245 - DNA, 254 bp, Unknown
  Kingdom: Bacteria, Phylum: Proteobacteria, Class: Gammaproteobacteria, Order: Xanthomonadales, Family: Xanthomonadaceae, Genus:
atacgaagggtgcaagcgttaatcggaattactgggcgtaaagcgtgcgtaggcggtttgttaagtctgctgtgaaatccccgggctcaacctgggaatggcagtggatactggcaagctagagtgtgtcagaggatggtggaattcccggtgtagcggtgaaatgcgtagagatcgggaggaacatcagtggcgaaggcggccatctgggacaacactgacgctgaggcacgaaagcgtggggagcaaacagg

SEQ ID NO: 1246 - DNA, 254 bp, Unknown
  Kingdom: Bacteria, Phylum: Proteobacteria, Class: Gammaproteobacteria, Order: Xanthomonadales, Family: Xanthomonadaceae, Genus:
atacggagggtgcaagcgttaatcggaattactgggcgtaaagcgtgcgtaggcggttcgttaagtctgctgtgaaagccccgggctcaacctgggaatggcagtggatactggcgagctagagtgtgatagaggatggtggaattcccggtgtagcggtgaaatgcgtagagatcgggaggaacatcagtggcgaaggcggccatctggatcaacactgacgctgaggcacgaaagcgtggggagcaaacagg

SEQ ID NO: 1247 - DNA, 254 bp, Unknown
  Kingdom: Bacteria, Phylum: Proteobacteria, Class: Gammaproteobacteria, Order: Xanthomonadales, Family: Xanthomonadaceae, Genus:
  misc_feature (59)..(59): n is a, c, g, or t
  misc_feature (70)..(70): n is a, c, g, or t
  misc_feature (104)..(104): n is a, c, g, or t
  misc_feature (115)..(116): n is a, c, g, or t
atacgaagggtgcaagcgttaatcggaattactgggcgtaaagggtgcgtaggcggttntttaagtctgncgtgaaatccccgggctcaacctgggaatggcgntggatactggnnagctagagtgtgtcagaggatggtggaattcccggtgtagcggtgaaatgcgtagagatcgggaggaacatcagtggcgaaggcggccatctgggacaacactgacgctgaagcacgaaagcgtggggagcaaacagg

SEQ ID NO: 1248 - DNA, 254 bp, Unknown
  Kingdom: Bacteria, Phylum: Proteobacteria, Class: Gammaproteobacteria, Order: Xanthomonadales, Family: Xanthomonadaceae, Genus:
atacgaagggtgcaagcgttaatcggaattactgggcgtaaagggtgcgtaggcggttcgttaagtctgtcgtgaaatccccgggctcaacctgggaatggcgatggatactggcgagctagagtgtgtcagaggatggtggaattcccggtgtagcggtgaaatgcgtagagatcgggaggaacatcagtggcgaaggcggccatctgggacaacactgacgctgaagcacgaaagcgtggggagcaaacagg

SEQ ID NO: 1249 - DNA, 254 bp, Unknown
  Kingdom: Bacteria, Phylum: Proteobacteria, Class: Gammaproteobacteria, Order: Xanthomonadales, Family: Xanthomonadales_Incertae_Sedis, Genus:
atacagagggtgcgagcgttaatcggaattactgggcgtaaagcgcgcgtaggcggcttttcaagtcggatgtgaaatccccgggcttaacctgggaactgcattcgagactgtctagctagagtatgggagagggaagtggaatttcaggtgtagcggtgaaatgcgtagatatctgaaggaacatcagtggcgaaagcgacttcctggaccaatactgacgctcatgtgcgaaagcgtggggagcaaacagg

SEQ ID NO: 1250 - DNA, 254 bp, Unknown
  Kingdom: Bacteria, Phylum: Proteobacteria, Class: Gammaproteobacteria, Order: Xanthomonadales, Family: Xanthomonadales_Incertae_Sedis, Genus:
atacagagggtgcgagcgttaatcggaattactgggcgtaaagcgcgcgtaggcggcttttcaagtcgattgtgaaatccccgggcttaacctgggaactgcagtcgagactgtctagctagagtatgggagagggaagtggaatttcaggtgtagcggtgaaatgcgtagatatctgaaggaacatcagtggcgaaagcgacttcctggaccaatactgacgctcatgtgcgaaagcgtggggagcaaacagg

SEQ ID NO: 1251 - DNA, 254 bp, Unknown
  Kingdom: Bacteria, Phylum: Proteobacteria, Class: Gammaproteobacteria, Order: Xanthomonadales, Family: Xanthomonadales_Incertae_Sedis, Genus:
atacagagggtgcgagcgttaatcggaattactgggcgtaaagcgcgcgtaggcggctttgcaagtcgggtgtgaaatccccaggcttaacctgggaactgcattcgagactgcattgctagagtatgggagagggaagtggaatttccggtgtagcggtgaaatgcgtagatatcggaaggaacatcagtggcgaaagcgacttcctggaccaatactgacgctcatgtgcgaaagcgtggggagcaaacagg

SEQ ID NO: 1252 - DNA, 254 bp, Unknown
  Kingdom: Bacteria, Phylum: Proteobacteria, Class: Gammaproteobacteria, Order: Xanthomonadales, Family:  , Genus:
atacagagggtgcgagcgttaatcggaattactgggcgtaaagcgtgcgcagacggtcatgtaagtcgggtgtgaaagccccgggctcaacctgggaattgcattcgagactgcatggctagggtgcggaagagggaagcggaatttccggtgtagcggtgaaatgcgtagatatcggaaggaacaccagtggcgaaagcggcttcctggtccagcaccgacgttcaggcacgaaagcgtggggagcaaacagg

SEQ ID NO: 1253 - DNA, 254 bp, Unknown
  Kingdom: Bacteria, Phylum: Proteobacteria, Class: Gammaproteobacteria, Order: Xanthomonadales, Family:  , Genus:
atacggagggtgcaagcgttaatcggaattactgggcgtaaagcgcacgcaggtggctgagaaagtcgattgtgaaagccctgggcttaacctgggaattgcagtcgaaactacttggctagagtatgggagagggcagtggaattcccggtgtagcggtgaaatgcgtagatatcgggaggaacatcagtggcgaaggcggctgcctggcccaatactgacactcaggtgcgacagcgtggggagcaaacagg

SEQ ID NO: 1254 - DNA, 254 bp, Unknown
  Kingdom: Bacteria, Phylum: Proteobacteria, Class: Gammaproteobacteria, Order: Xanthomonadales, Family:  , Genus:
atacggagggtgcaagcgttaatcggaattactgggcgtaaagcgcacgcaggtggctgagtcagtcgattgtgaaagccctgggcttaacctgggaattgcagtcgatactactcagctagagtatgggagagggtagtggaattcccggtgtagcggtgaaatgcgtagatatcgggaggaacatcagtggcgaaggcggctacctggcccaatactgacactcaggtgcgacagcgtggggagcaaacagg

SEQ ID NO: 1255 - DNA, 254 bp, Unknown
  Kingdom: Bacteria, Phylum: Proteobacteria, Class: Gammaproteobacteria, Order: Xanthomonadales, Family:  , Genus:
atacagagggtgcgagcgttaatcggaattactgggcgtaaagcgcgcgtagacggttttgtaagtcagatgtgaaatccctgggctcaacctgggaactgcatttgaaactgcatggctagagtatcggagagggaagtggaatttccggtgtagcggtgaaatgcgtagatatcggaaggaacaccagtggcgaaagcgacttcctggtcgaatactgacgttcatgtgcgaaagcgtggggagcaaacagg

SEQ ID NO: 1256 - DNA, 254 bp, Unknown
  Kingdom: Bacteria, Phylum: Proteobacteria, Class: Gammaproteobacteria, Order: Xanthomonadales, Family:  , Genus:
atacagagggtgcaagcgttaatcggaattactgggcgtaaagcgcacgtaggtggcttgataagttgggtgtgaaatccccgggcttaacctgggaattgcattcaagactgtcttgctagagtgtggaagagggaagcggaattccaggtgtagcggtgaaatgcgtagatatctggaggaacatcagtggcgaaggcggcttcctggtccaacactgacactgaggtgcgaaagcgtggggagcaaacagg

SEQ ID NO: 1257 - DNA, 254 bp, Unknown
  Kingdom: Bacteria, Phylum: Proteobacteria, Class: Gammaproteobacteria, Order: Xanthomonadales, Family:  , Genus:
atacagagggtgcgagcgttaatcggaattactgggcgtaaagcgtgcgtagacggttatttaagtcgggtgtgaaagccccgggctcaacctgggaattgcattcgagactgaatagctagggtacggtagagggaagcggaatttccggtgtagcggtgaaatgcgtagatatcggaaggaacatcagtggcgaaagcggcttcctggaccagtaccgacgttcaggcacgaaagcgtggggagcaaacagg

SEQ ID NO: 1258 - DNA, 254 bp, Unknown
  Kingdom: Bacteria, Phylum: Proteobacteria, Class: Gammaproteobacteria, Order: Xanthomonadales, Family:  , Genus:
atacagagggtgcaagcgttaatcggaattactgggcgtaaagcgtgcgtagacggttatgtaagtcagatgtgaaagccccgggctcaacctgggaattgcatttgagactgcatagctagggtgcggaagagggaagcggaatttccggtgtagcggtgaaatgcgtagatatcggaaggaacaccagtggcgaaagcggcttcctggtccagcaccgacgttcaggcacgaaagcgtggggagcaaacagg

SEQ ID NO: 1259 - DNA, 254 bp, Unknown
  Kingdom: Bacteria, Phylum: Proteobacteria, Class: Gammaproteobacteria, Order: Xanthomonadales, Family:  , Genus:
atacagagggtgcaagcgttaatcggaattactgggcgtaaagcgtgcgtagacggttacataagtcgggtgtgaaagccccgggctcaacctgggaattgcattcgagactgcgtagctagggtgcggaagagggaagcggaatttccggtgtagcggtgaaatgcgtagatatcggaaggaacaccagtggcgaaagcggcttcctggtccagcaccgacgttcaggcacgaaagcgtggggagcaaacagg

SEQ ID NO: 1260 - DNA, 254 bp, Unknown
  Kingdom: Bacteria, Phylum: Proteobacteria, Class: Gammaproteobacteria, Order: Xanthomonadales, Family:  , Genus:
atacagagggtgcgagcgttaatcggaattactgggcgtaaagcgtgcgtagacggttatttaagtcgggtgtgaaagccccgggctcaacctgggaattgcattcgagactgaatagctagggtacggtagagggaagtggaatttccggtgtagcggtgaaatgcgtagatatcggaaggaacatcagtggcgaaagcgacttcctggaccagtaccgacgttcaggcacgaaagcgtggggagcaaacagg

SEQ ID NO: 1261 - DNA, 254 bp, Unknown
  Kingdom: Bacteria, Phylum: Spirochaetae, Class: Spirochaetes, Order: Spirochaetales, Family: Leptospiraceae, Genus:
atacgtatggggcaagcgttgttcggaattattgggcgtaaagggctcgcaggtggtttgttaagttggtggtttaatctctgggctcaacccagagtcagcctccaaaactggcgaacttgagtacgataggggatagcggaattctcggtgtagcggtggaatgcgtagatatcgagaggaacaccaatggcgaaggcagctatctggatcgtaactgacactcatgagcgaaagtgcggggagcaaacagg

SEQ ID NO: 1262 - DNA, 252 bp, Unknown
  Kingdom: Bacteria, Phylum: Tenericutes, Class: Mollicutes, Order: Entomoplasmatales, Family: Spiroplasmataceae, Genus:
tacataggtggcaagcgttatccggatttattgggcgtaaagcgtgcgtagacggttctgcaagtctgaggttaaatctaggagctcaactcctatccgcctcggaaactacagtactagagtatagaagaggttagtggaatttcatgtgtagcggtggaatgcgtagatatatgaaggaacaacagtggcgaaggcggctaactggtctaatactgacgttgtggcacgaaagcgtggggagcaaatagg

SEQ ID NO: 1263 - DNA, 253 bp, Unknown
  Kingdom: Bacteria, Phylum: Tenericutes, Class: Mollicutes, Order: Mollicutes_Incertae_Sedis, Family: Unknown_Family, Genus:
atacatagggggcaagcgttatccggaattattgggcgtaaagggtgcgtaggcggttaaataagtttatggtctaagtgcaatgctcaacattgtgatgctataaaaactgtttagctagagtaagatagaggcaagtggaattccatgtgtagtggtaaaatgcgtaaatatatggaggaacaccagtagcgaaggcggcttgctgggtctttactgacgctgaggcacgaaagcgtggggagcaaacagg

SEQ ID NO: 1264 - DNA, 253 bp, Unknown
  Kingdom: Bacteria, Phylum: Tenericutes, Class: Mollicutes, Order: Mollicutes_Incertae_Sedis, Family: Unknown_Family, Genus:
atacatagggggcaagcgttatccggaattattgggcgtaaagggtgcgtaggctgttaaataagtttatggtctaagtgcaatgctcaacattgtgatgctataaaaactgtttagctagagtaagatagaggcaagtggaattccatgtgtagtggtaaaatgcgtaaatatatggaggaacaccagtagcgaaggcggcttgctgggtctttactgacgctgaggcacgaaagcgtggggagcaaacagg

SEQ ID NO: 1265 - DNA, 253 bp, Unknown
  Kingdom: Bacteria, Phylum: Tenericutes, Class: Mollicutes, Order: Mycoplasmatales, Family: Mycoplasmataceae, Genus:
aaacataggtcacgagcattatccggatttattgggcgtaaaggaagcgtaggtggggaggttgatccattgttaaaggcatttgcttaacaaatgtgtgcgatggagatcgcctccctagagttaatcagggggtactggaattcaatgtgtagcggtggaatgcgtagatatattgaggaacaccagaggctaaggcgagtgcctaggatataactgacactgaggcttgaaagcgtggggagcaaatggg

SEQ ID NO: 1266 - DNA, 253 bp, Unknown
  Kingdom: Bacteria, Phylum: Tenericutes, Class: Mollicutes, Order: Mycoplasmatales, Family: Mycoplasmataceae, Genus:
aaacataggtcacgagcattatccggatttattgggcgtaaaggaagcgtaggcggggaggttgatccattgttaaaagcatttgcttaacaaatgtgtgcattggagatcgcctccctagagttaatcagggggtactggaattcaatgtgtagcggtggaatgcgtagatatattgaggaacaccagaggctaaggcgagtacctaggatataactgacgctgaggcttgaaagcgtggggagcaaatggg

SEQ ID NO: 1267 - DNA, 251 bp, Unknown
  Kingdom: Bacteria, Phylum: Thermi, Class: Deinococci, Order: Deinococcales, Family: Deinococcaceae, Genus: Deinococcus
tacggagggtgcaagcgttacccggaatcactgggcgtaaagggcgtgtaggcggccccctaagtctgactttaaagactgcggctcaaccgcagcagtgggttggagactgggggactagacctgtggagaggcaactggaattcctggaggagcggtggaatgcgtagatcccaggaggaacaccaacggcgaaggcaggttgctggacacggtgacgctgaggcgcgaaagtgtggggagcaaaccgg

SEQ ID NO: 1268 - DNA, 251 bp, Unknown
  Kingdom: Bacteria, Phylum: TM6, Class: SJA-4, Order:  , Family: , Genus:
tacgagtggtgctagcgttattcggatttattgggcgtaaagggtgcgtagacggtatgacaagtctgttgttaaattcctcggctcaactgaggatctgcgatggaaactgtcgtgctagaggatggaagagagaagtggaattcttggagtagcggtaaaatgcgtagatctcaagaggaacaccgatggcgaaggcagcttcttggtccacctgacgttgaggcacgaaagcgtggggagcaaacagg

SEQ ID NO: 1269 - DNA, 251 bp, Unknown
  Kingdom: Bacteria, Phylum: TM6, Class: SJA-4, Order:  , Family: , Genus:
tacgaggggtgcaagcgttattcggaatcattgggcgtaaagggtgcgtagacggcttatcaagtcaactgttaaattctccggcctaactggaggtcagcagtagaaactgataggcttgaggttggaagagagaagtggaattctcggagtagcggtaaaatgcgtagatctcgagaggaacaccgatggcgaaggcagcttcttggtccacctgacgttgaggcacgaaagcgtggggagcaaacagg

SEQ ID NO: 1270 - DNA, 250 bp, Unknown
  Kingdom: Bacteria, Phylum: TM6, Class: SJA-4, Order:  , Family: , Genus:
tacgaagggtgcaacgttattcggatttattgggcgtaaagggtgcgtagacggtatattaagtctattgttaaatcttctggcctaaccagaaatctgcagtagatactgatgtgctagagggtggaagagagaagtggaattctcggagtagcggtaaaatgcgtagatctcgagaggaacaccaatggcgaaggcagcttcttggtccacctgacgttgaggcacgaaagcgtggggagcaaacagg

SEQ ID NO: 1271 - DNA, 251 bp, Unknown
  Kingdom: Bacteria, Phylum: TM6, Class: SJA-4, Order:  , Family: , Genus:
tacgaggggtgcaagcgttattcggaatcattgggcgtaaagggtgcgtagacggcttattaagtcaactgttaaattctccggcctaactggaggtcagcggtagaaactaataagcttgaggttggaagagagaagtggaattctcggagtagcggtaaaatgcgtagatctcgagaggaacaccgatggcgaaggcagcttcttggtccacctgacgttgaggcacgaaagcgtggggagcaaacagg

SEQ ID NO: 1272 - DNA, 251 bp, Unknown
  Kingdom: Bacteria, Phylum: TM6, Class: SJA-4, Order:  , Family: , Genus:
tacgaggggtgcaagcgttattcggaattattgggcgtacagggtgcgtagacggtatgttaagtcaactgttaaattccccggcttaactgggggccagcagtagatactgatgtgctagaggatggaagagagaagtggaattctcggagtagcggtaaaatgcgtagatctcgagaggaacaccgatggcgaaggcagcttcttggtccatctgacgttgaggcacgaaagcgtggggagcaaacagg

SEQ ID NO: 1273 - DNA, 251 bp, Unknown
  Kingdom: Bacteria, Phylum: TM6, Class: SJA-4, Order:  , Family: , Genus:
tacgagtggtgcaagcgttattcggaatcattgggcgtaaagggcgcgtagacggtatgttaagtctgttgttaaattccttagcttaactgagggtatgcagcggaaactggcgtgctagaggatggaagagagaagtggaattctcggagtagcggtaaaatgcgtagatctcgagaggaacaccaatggcgaaggcagcttcttggtccatctgacgttgaggcgcgaaagcgtggggagcaaacagg

SEQ ID NO: 1274 - DNA, 254 bp, Unknown
  Kingdom: Bacteria, Phylum: TM6, Class:  , Order:  , Family:  , Genus:
atacgaagggtgcaaacgttattcggaatcactgggcgtaaagggtgtgtagacggcctactaagttcgttgtttaatcttccggcctaaccggaagctcgcgatggaaactggtaagcttgaggatggaagagagaagtggaattctcggagtagcggtaaaatgcgtagatctcgagaggaacaccgatggcgaaggcagcttcttggtccactcctgacgttgagacacgaaagcgtgggtagcaaacagg

SEQ ID NO: 1275 - DNA, 254 bp, Unknown
  Kingdom: Bacteria, Phylum: Verrucomicrobia, Class: OPB35_soil_group, Order:  , Family:  , Genus:
atacagaggtcccgagcgttgttcggattcactgggcgtaaagggtgcgtaggtggcatggtaagtttgatgtgaaagctcagggctcaaccctgaaatggcattgaatactactgtgctggaggtttggaggggggactggaattcttggtgtagcagtgaaatgcgtagatatcaagaggaacaccagtggcgaaggcgagtccctggacaacacctgacactgaggcacgaaagctaggggagcaaacagg

SEQ ID NO: 1276 - DNA, 254 bp, Unknown
  Kingdom: Bacteria, Phylum: Verrucomicrobia, Class: OPB35_soil_group, Order:  , Family:  , Genus:
atacagaggtcccgagcgttgttcggattcactgggcgtaaagggtgcgtaggtggcatggtaagtttgatgtgaaagctcagggctcaaccctgaaatggcattgaatactactgtgctggaggtttggaggggggactggaattcttggtgtagcagtgaaatgcgtagatatcaagaggaacaccagtggcgtaggcgagtccctggacaacacctgacactgaggcacgaaagccgggggagcaaacagg

SEQ ID NO: 1277 - DNA, 254 bp, Unknown
  Kingdom: Bacteria, Phylum: Verrucomicrobia, Class: OPB35_soil_group, Order:  , Family:  , Genus:
atacagaggtcccaagcgttgttcggattcactgggcgtaaagggtgcgtaggtggtcgggtaagtctgatgtgaaatctcggagctcaactccgaaactgcattggatactatccggctggagggtcggaggggggactggaattctcggtgtagcagtgaaatgcgtagatatcgagaggaacaccagtggcgaaggcgagtccctggacgactcctgacactgaggcacgaaagctaggggagcaaacagg

SEQ ID NO: 1278 - DNA, 254 bp, Unknown
  Kingdom: Bacteria, Phylum: Verrucomicrobia, Class: OPB35_soil_group, Order:  , Family:  , Genus:
atacagaggtcccgagcgttgttcggattcactgggcgtaaagggtgcgtaggtggcatgttaagtttgatgtgaaagctcagggctcaaccctgaaatggcattgaatactagcgtgctggaggtttggaggggggactggaattctcggtgtagcagtgaaatgcgtagatatcgagaggaacaccagtggcgaaggcgagtccctggacaacacctgacactgaggcacgaaagctaggggagcaaacagg

SEQ ID NO: 1279 - DNA, 254 bp, Unknown
  Kingdom: Bacteria, Phylum: Verrucomicrobia, Class: OPB35_soil_group, Order:  , Family:  , Genus:
atacagaggtcccgagcgttgttcggattcactgggcgtaaagggtgcgtaggtggtgaggtaagtcggatgtgaaatctccgggctcaacccggaaatggcattggaaactaccttgctggaggatttgaggggggattggaatacttggtgtagcagtgaaatgcgtagatatcaagtggaacaccagtggcgaaggcgaatccctggaaaatacctgacactgaggcacgaaagctaggggagcaaacagg

SEQ ID NO: 1280 - DNA, 254 bp, Unknown
  Kingdom: Bacteria, Phylum: Verrucomicrobia, Class: OPB35_soil_group, Order:  , Family:  , Genus:
atacagaggtcccgagcgttgttcggattcactgggcgtaaagggtgcgtaggtggtgaggtaagtcggatgtgaaacctccaggctcaacctggaaactgcattggaaactaccttgcttgaggatttgaggggggattggaatacttggtgtagcagtgaaatgcgtagatatcaagtggaacaccagtggcgaaggcgaatccctggaaaatacctgacactgaggcacgaaagctaggggagcaaacagg

SEQ ID NO: 1281 - DNA, 254 bp, Unknown
  Kingdom: Bacteria, Phylum: Verrucomicrobia, Class: OPB35_soil_group, Order:  , Family:  , Genus:
atacagaggtcccaagcgttgttcggattcactgggcgtaaagggtgcgtaggcggtcgggtaagtctgacgtgaaatcttcaagctcaacttggaaactgcgtcggatactattcggctagaggaatggaggggagactggaatacttggtgtagcagtgaaatgcgtagatatcaagtggaacaccagtggcgaaggcgagtctctggacatttcctgacgctgaggcacgaaagccaggggagcaaacggg

SEQ ID NO: 1282 - DNA, 254 bp, Unknown
  Kingdom: Bacteria, Phylum: Verrucomicrobia, Class: OPB35_soil_group, Order:  , Family:  , Genus:
atacagaggtcccaagcgttgttcggattcactgggcgtaaagggtgcgtaggcggtcgggtaagtctgatgtgaaatctcacagcttaactgtgaaactgcattggatactattcggcttgagagttggaggggggactggaattcttggtgtagcagtgaaatgcgtagatatcaagaggaacaccagtggcgaaggcgagtccctggacaacttctgacgctgaggcacgaaagctaggggagcaaacagg

SEQ ID NO: 1283 - DNA, 254 bp, Unknown
  Kingdom: Bacteria, Phylum: Verrucomicrobia, Class: OPB35_soil_group, Order:  , Family:  , Genus:
  misc_feature (43)..(43): n is a, c, g, or t
  misc_feature (52)..(52): n is a, c, g, or t
atacagaggtcccaagcgttgttcggattcactgggcgtaaanggtgcgtangcggtcgggtaagtctggcgtgaaatctccgagcctaactcggaaactgcgctggatactatccggcttgaggaatggaggggagactggaatacttggtgtagcagtgaaatgcgtagatatcaagtggaacaccagtggcgaaggcgagtctctggacatttcctgacgctgaggcacgaaagccaggggagcaaacggg

SEQ ID NO: 1284 - DNA, 254 bp, Unknown
  Kingdom: Bacteria, Phylum: Verrucomicrobia, Class: OPB35_soil_group, Order:  , Family:  , Genus:
atacagaggtcccaagcgttgttcggattcactgggcgtaaagggtgcgtaggcggttgggtaagtctgacgtgaaatctccgggcctaacccggaaactgcgttggatactatccggctagaggaatggaggggagactggaatacttggtgtagcagtgaaatgcgtagatatcaagtggaacaccagtggcgaaggcgagtctctggacatttcctgacgctgaggcacgaaagccaggggagcaaacggg

SEQ ID NO: 1285 - DNA, 254 bp, Unknown
  Kingdom: Bacteria, Phylum: Verrucomicrobia, Class: OPB35_soil_group, Order:  , Family:  , Genus:
atacagaggtcccgagcgttgttcggattcactgggcgtaaagggtgcgtaggtggtgaggtaagtcggatgtgaaatctccaggctcaacctggaaactgcattggaaactaccttgcttgagggtttgaggggggactggaattctcggtgtagcagtgaaatgcgtagatatcgagaggaacaccggtggcgaaggcgagtccctggaaaacacctgacactgaggcacgaaagctaggggagcaaacagg

SEQ ID NO: 1286 - DNA, 254 bp, Unknown
  Kingdom: Bacteria, Phylum: Verrucomicrobia, Class: Opitutae, Order: Opitutales, Family: Opitutaceae, Genus: Opitutus
atacagagactgcgagcgttattcggattcactgggcgtaaagggtgcgcaggcggccatgtgtgtgaggcgtgaaagcccggggcttaaccccggaattgcacctcaaactacatggctagagcattggagagggtagcggaattcacggtgtagcagtgaaatgcgtagatatcgtgaggaacaccagaggcgaaggcggctacctggacaattgctgacgctcaggcacgaaagcgtggggagcaaaaggg

SEQ ID NO: 1287 - DNA, 254 bp, Unknown
  Kingdom: Bacteria, Phylum: Verrucomicrobia, Class: Opitutae, Order: Opitutales, Family: Opitutaceae, Genus: Opitutus
atacagagactgcaagcgttattcggattcactgggcgtaaagggtgcgcaggtggtcgtgtgtgtcagatgtgaaatcccggagcttaactccggaactgcgtctgaaactgcacgactagagcattggagagggtagtggaattcacggtgtagcagtgaaatgcgtagatatcgtgaggaacaccagaggcgaaggcgactacctggacaattgctgacactcaggcacgaaagcatggggagcaaaaggg

SEQ ID NO: 1288 - DNA, 254 bp, Unknown
  Kingdom: Bacteria, Phylum: Verrucomicrobia, Class: Opitutae, Order: Opitutales, Family: Opitutaceae, Genus:
atacagagactgcaagcgttattcggattcactgggcgtaaagggtgcgcaggcggccaagtgtgttaggtgtgaaagcccggggcttaaccccggaattgcacctaaaactacatggctagagcattggagagggtagcggaattcacggtgtagcagtgaaatgcgtagatatcgtgaggaacaccagaggcgaaggcggctacctggacaattgctgacgctcaggcacgaaagcgtggggagcaaaaggg

SEQ ID NO: 1289 - DNA, 254 bp, Unknown
  Kingdom: Bacteria, Phylum: Verrucomicrobia, Class: Opitutae, Order: Opitutales, Family: Opitutaceae, Genus:
atacagagactgcaagcgttattcggattcactgggcgtaaagggtgcgcaggcggttgggtgtgtcagatgtgaaatcccgaggcttaacctcggaactgcgtctgaaactactcgactagagtactggagagggtaacggaattcacggtgtagcagtgaaatgcgtagatatcgtgaggaacaccagaggcgaaggcggttacctggacagttactgacgctcaggcacgaaagcatggggagcaaaaggg

SEQ ID NO: 1290 - DNA, 254 bp, Unknown
  Kingdom: Bacteria, Phylum: Verrucomicrobia, Class: Opitutae, Order: Opitutales, Family: Opitutaceae, Genus:
atacagagactgcaagcgttattcggattcactgggcgtaaagggtgcgcaggcggccgtgtgtgtcaggtgtgaaagcccgaggctcaacctcggaattgcgcctgaaactacacggctagagtactggagagggtagcggaattcatggtgtagcagtgaaatgcgtagatatcatgaggaacaccagaggcgaaggcggctacctggacagttactgacgctcaggcacgaaagcgtggggagcaaaaggg

SEQ ID NO: 1291 - DNA, 254 bp, Unknown
  Kingdom: Bacteria, Phylum: Verrucomicrobia, Class: Opitutae, Order: Opitutales, Family: Opitutaceae, Genus:
atacagagactgcaagcgttattcggattcactgggcgtaaagggtgcgcaggtggccaagtgtgtcaggtgtgaaatcccggggcttaactccggaactgcgcctgaaactgcttggctagagcattggagagggaagtggaattcacggtgtagcagtgaaatgcgtagatatcgtgaggaacaccagaggcgaaggcgacttcctggacaattgctgacactcaggcacgaaagcgtgggtagccaaaggg

SEQ ID NO: 1292 - DNA, 254 bp, Unknown
  Kingdom: Bacteria, Phylum: Verrucomicrobia, Class: Opitutae, Order: Opitutales, Family: Opitutaceae, Genus:
atacagagactgcaagcgttattcggattcactgggcgtaaagggtgcgcaggcggccgtgtgtgtgaggcgtgaaagcccgatgcttaacatcggaattgcacctcaaactacacggctagagcattggagagggtagcggaattcacggtgtagcagtgaaatgcgtagatatcgtgaggaacaccagaggcgaaggcggctacctggacaattgctgacgctcaggcacgaaagcgtggggagcaaaaggg

SEQ ID NO: 1293 - DNA, 254 bp, Unknown
  Kingdom: Bacteria, Phylum: Verrucomicrobia, Class: Opitutae, Order: Opitutales, Family: Opitutaceae, Genus:
atacagagactgcaagcgttattcggattcactgggcgtaaagggtgcgcaggcggccaagtgtgtgaggcgtgaaagcccggagctcaactccggaattgcacctcaaactacatggctagagcattggagagggtagcagaattcacggtgtagcagtgaaatgcgtagatatcgtgaggaataccagaggcgaaggcggctacctggacaattgctgacgctcaggcacgaaagcgtggggagcaaaaggg

SEQ ID NO: 1294 - DNA, 254 bp, Unknown
  Kingdom: Bacteria, Phylum: Verrucomicrobia, Class: Opitutae, Order: Opitutales, Family: Opitutaceae, Genus:
atacagagactgcaagcgttattcggattcactgggcgtaaagggtgcgcaggcggtcgtgtgtgtcagatgtgaaatcccggagcttaactccggaactgcgtctgaaactacacgactagagcattggagagggaagtggaattcatggtgtagcagtgaaatgcgtagatatcatgaggaacaccagaggcgaaggcgacttcctggacaattgctgacgctcaggcacgaaagcatggggagcaaaaggg

SEQ ID NO: 1295 - DNA, 254 bp, Unknown
  Kingdom: Bacteria, Phylum: Verrucomicrobia, Class: Opitutae, Order: Opitutales, Family: Opitutaceae, Genus:
atacagagactgcaagcgttattcggattcactgggcgtaaagggtgcgcaggcggccaagtgtgtgaggcgtgaaagcccggggcttaaccccggaattgcacctcaaactacatggctagagcattggagagggtagcagaattcatggtgtagcagtgaaatgcgtagatatcatgaggaataccagaggcgaaggcggctacctggacaattgctgacgctcaggcacgaaagcgtggggagcaaaaggg

SEQ ID NO: 1296 - DNA, 254 bp, Unknown
  Kingdom: Bacteria, Phylum: Verrucomicrobia, Class: Opitutae, Order: Opitutales, Family: Opitutaceae, Genus:
atacagagactgcaagcgttattcggattcactgggcgtaaagggtgcgcaggcggttgggtgtgtcagatgtgaaatcccgaggctcaacctcggaactgcgtctgaaactactcgactagagtactggagagggtaacggaattcacggtgtagcagtgaaatgcgtagatatcgtgaggaacaccagaggcgaaggcggttacctggacagttactgacgctcaggcacgaaagcatggggagcaaaaggg

SEQ ID NO: 1297 - DNA, 254 bp, Unknown
  Kingdom: Bacteria, Phylum: Verrucomicrobia, Class: Opitutae, Order: Opitutales, Family: Opitutaceae, Genus:
atacagagactgcaagcgttattcggattcactgggcgtaaagggtgcgcaggcggccatgtgtgtgaggcgtgaaagcccgatgctcaacatcggaattgcacctcaaactacatggctagagcattggagagggaagcggaattcacggtgtagcagtgaaatgcgtagatatcgtgaggaacaccagaggcgaaggcggcttcctggacaattgctgacgctcaggcacgaaagcgtggggagcaaaaggg

SEQ ID NO: 1298 - DNA, 251 bp, Unknown
  Kingdom: Bacteria, Phylum: Verrucomicrobia, Class: Pedosphaerae, Order: Pedosphaerales, Family:  , Genus:
tacagaggtcccaagcgttgttcggatttactgggcgtaaagggagcgtaggtggcattctaagtctgatgtgaaagctctgagcttaactcagaaatggcattagatactagtttgcttgaggattggaggggagattggaatacttggtgtagcagtgaaatgcgtagatatcaagtggaacaccagtggcgaaggcgaatctctggacaacctgacactgatgctcgaaagctaggggagcaaacggg

SEQ ID NO: 1299 - DNA, 254 bp, Unknown
  Kingdom: Bacteria, Phylum: Verrucomicrobia, Class: Spartobacteria, Order: Chthoniobacterales, Family: Chthoniobacteraceae, Genus: Chthoniobacter
atacagaggtctcaaccgttgttcggattcattgggcgtaaagggtgcgtaggcggtcgcgtaagtcggatgtgaaatctcagggctcaaccctgaaactgcattcgatactgcgtggctagggtactggagaggagactggaatttacggtgtagcagtgaaatgcgtagatatcgtaaggaagaccagtggcgaaggcgagtctctggacagttaccgtcgctgaggcacgaaggccaggggagcaaacggg

SEQ ID NO: 1300 - DNA, 254 bp, Unknown
  Kingdom: Bacteria, Phylum: Verrucomicrobia, Class: Spartobacteria, Order: Chthoniobacterales, Family: Chthoniobacteraceae, Genus: Chthoniobacter
atacagaggtctcaaccgttgttcggattcattgggcgtaaagggtgcgtaggcggtcgcgcaagtcggatgtgaaatcttagggctcaaccctgaaactgcattcgatactgcgtggctcgagtactggagaggagactggaatttacggtgtagcagtgaaatgcgtagatatcgtaaggaagaccagtggcgaaggcgagtctctggacagttactgacgctgaggcacgaaggccaggggagcaaacggg

SEQ ID NO: 1301 - DNA, 254 bp, Unknown
  Kingdom: Bacteria, Phylum: Verrucomicrobia, Class: Spartobacteria, Order: Chthoniobacterales, Family: Chthoniobacteraceae, Genus:
atacagaggtctcaagcgttgttcggattcattgggcgtaaagggtgcgtaggtggcggggtaagtcaggtgtgaaatctcggagctcaactccgaaactgcacttgatactgccttgctggagtactggagaggagattggaatttacggtgtagcagtgaaatgcgtagatatcgtaaggaagaccagtggcgaaagcgaatctctggacagttactgacactgaggcacgaaggccaggggagcaaacggg

SEQ ID NO: 1302 - DNA, 251 bp, Unknown
  Kingdom: Bacteria, Phylum: Verrucomicrobia, Class: Spartobacteria, Order: Chthoniobacterales, Family: Chthoniobacteraceae, Genus:
tacagaggtcccgagcgttgttcggattcattgggcgtaaagggtgcgtaggcggcggggcaagtctgatgtgaaatcccggggctcaaccccggaactgcattggatactgccttgctagagtactggagaggaaactggaatttacggtgtagcagtgaaatgcgtagagatcgtaaggaaggccagtggcgaaggcgagtttctggacagactgacgctgaggcacgaaggccaggggagcaaacggg

SEQ ID NO: 1303 - DNA, 251 bp, Unknown
  Kingdom: Bacteria, Phylum: Verrucomicrobia, Class: Spartobacteria, Order: Chthoniobacterales, Family: Chthoniobacteraceae, Genus:
tacagaggtctcaagcgttgttcggattcattgggcgtaaagggtgcgtaggtggcggggcaagtctggtgtgaaatcccggggctcaaccccggaactgcactggatactgccttgctagagcactggagagggaactggaatttacggtgtagcagtgaaatgcgtagatatcgtaaggaagaccagtggcgaaggcgagttcctggacaggctgacactgaggcacgaaggctaggggagcaaacggg

SEQ ID NO: 1304 - DNA, 254 bp, Unknown
  Kingdom: Bacteria, Phylum: Verrucomicrobia, Class: Spartobacteria, Order: Chthoniobacterales, Family: DA101_soil_group, Genus:
atacagaggtctcaagcgttgttcggattcattgggcgtaaagggtgcgtaggtggcgcgctaagtcaggtgtgaaatttcggagcttaactccgaaactgcatttgatactggcgtgcttgaggactggagaggagactggaattcacggtgtagcagtgaaatgcgtagagatcgtgaggaagaccagtggcgaaggcgggtctctggacagttcctgacactgaggcacgaaggccaggggagcaaacggg

SEQ ID NO: 1305 - DNA, 254 bp, Unknown
  Kingdom: Bacteria, Phylum: Verrucomicrobia, Class: Spartobacteria, Order: Chthoniobacterales, Family: DA101_soil_group, Genus:
atacagaggtctcaagcgttgttcggattcattgggcgtaaagggtgtgtaggtggcgcgctaagtcgggtgtgaaatttcggagcttaactccgaaactgcattcgatactggcgtgcttgaggactggagaggagactggaattcatggtgtagcagtgaaatgcgtagagatcatgaggaagaccagtggcgaaggcgggtctctggacagttcctgacactgagacacgaaggccaggggagcaaacggg

SEQ ID NO: 1306 - DNA, 254 bp, Unknown
  Kingdom: Bacteria, Phylum: Verrucomicrobia, Class: Spartobacteria, Order: Chthoniobacterales, Family: DA101_soil_group, Genus:
atacagaggtctcaagcgttgttcggattcattgggcgtaaagggtgcgtaggtggcgccgtaagtcgggtgtgaaatttcggagcttaactccgaaactgcattcgatactgcggtgcttgaggactggagaggagactggaattcatggtgtagcagtgaaatgcgtagagatcatgaggaagaccagtggcgaaggcgggtctctggacagttcctgacactgaggcacgaaggccaggggagcaaacggg

SEQ ID NO: 1307 - DNA, 254 bp, Unknown
  Kingdom: Bacteria, Phylum: Verrucomicrobia, Class: Spartobacteria, Order: Chthoniobacterales, Family: DA101_soil_group, Genus:
atacagaggtctcaagcgttgttcggattcattgggcgtaaagggtgcgtaggcggcgcggtaagtcgggtgtgaaatctcggagcttaactccgaaactgcattcgatactgccgtgcttgaggactggagaggagactggaatttacggtgtagcggtgaaatgcgtagatatcgtaaggaagaccagtggcgaaggcgggtctctggacagttcctgacgctgaggcacgaaggtcaggggagcaaacggg

SEQ ID NO: 1308 - DNA, 254 bp, Unknown
  Kingdom: Bacteria, Phylum: Verrucomicrobia, Class: Spartobacteria, Order: Chthoniobacterales, Family: DA101_soil_group, Genus:
atacagaggtctcaagcgttgttcggattcattgggcgtaaagggtgcgtaggcggcgcggtaagtcgggtgtgaaatcttggagcttaactccgaaactgcattcgatactgccgtgcttgaggactggagaggagactggaatttacggtgtagcggtgaaatgcgtagatatcgtaaggaagaccagtggcgaaggcgggtctctggacagttcctgacgctgaggcacgaaggccaggggagcaaacggg

SEQ ID NO: 1309 - DNA, 254 bp, Unknown
  Kingdom: Bacteria, Phylum: Verrucomicrobia, Class: Spartobacteria, Order: Chthoniobacterales, Family: DA101_soil_group, Genus:
atacagaggtctcaagcgttgttcggattcattgggcgtaaagggtgcgtaggtggcgcggtaagtcgggtgtgaaatctcggagcttaactccgaaattgcattcgatactgccgtgcttgaggactggagaggagactggaattcatggtgtagcagtgaaatgcgtagagatcatgaggaagaccagtggcgaaggcgggtctctggacagttcctgacactgaggcacgaaggccaggggagcaaacggg

SEQ ID NO: 1310 - DNA, 254 bp, Unknown
  Kingdom: Bacteria, Phylum: Verrucomicrobia, Class: Verrucomicrobiae, Order: Verrucomicrobiales, Family: Verrucomicrobiaceae, Genus: Brevifollis
atacagaggtctcaagcgttgttcggaatcactgggcgtaaagggtgcgtaggtggcgtggtaagtcagatgtgaaagcccggggctcaacctcggaattgcatccgatactgccgtgcttgagtactggagaggtgactagaattctaggtgtagcagtgaaatgcgtagatatctagaggaataccaaaggcgtaggcaggtcactggacagttactgacactgaggcacgaaggccaggggagcaaacggg

SEQ ID NO: 1311 - DNA, 254 bp, Unknown
  Kingdom: Bacteria, Phylum: Verrucomicrobia, Class: Verrucomicrobiae, Order: Verrucomicrobiales, Family: Verrucomicrobiaceae, Genus: Haloferula
atacgaaggtcccgagcgttgttcggaatcactgggcgtaaagggagcgtaggcggcgcggtaagtcagatgtgaaatcccggggctcaaccccggaactgcatccgatactgccgtgcttgagggttggagaggtagctggaattctcggtgtagcagtgaaatgcgtggatttcgagaggaacactcgtggcgaaggcgagctactggacaacatctgacgctgaggctcgaaggccgggggagcaaaaggg

SEQ ID NO: 1312 - DNA, 251 bp, Unknown
  Kingdom: Bacteria, Phylum: Verrucomicrobia, Class: Verrucomicrobiae, Order: Verrucomicrobiales, Family: Verrucomicrobiaceae, Genus: Luteolibacter
tacgaaggtcccgagcgttgttcggaatcactgggcgtaaagggagcgtaggcggcgcggtaagtcagatgtgaaatcccggggctcaaccccggaactgcatccgatactgccgtgctagaggattggagaggtagctggaattcttggtgtagcagtgaaatgcgtggagatcaagaggaacactcgtggcgaaagcgagctactggacaatctgacgctgaggctcgaaggccagggtagcgaaaggg

SEQ ID NO: 1313 - DNA, 254 bp, Unknown
  Kingdom: Bacteria, Phylum: Verrucomicrobia, Class: Verrucomicrobiae, Order: Verrucomicrobiales, Family: Verrucomicrobiaceae, Genus:
atacgaaggtcccgagcgttgttcggaatcactgggcgtaaagggagcgtaggcggcgcggtaagtcagatgtgaaatcccggggctcaaccccggaactgcatccgatactgccgtgctagaggattggagaggtagctggaattcttggtgtagcagtgaaatgcgtggagatcaagaggaacactcgtggcgaaagcgagctactggacaatatctgacgctgaggctcgaaggccagggtagcgaaaggg

SEQ ID NO: 1314 - DNA, 254 bp, Unknown
  Kingdom: Bacteria, Phylum: Verrucomicrobia, Class: Verrucomicrobiae, Order: Verrucomicrobiales, Family: Verrucomicrobiaceae, Genus:
atacgaaggtcccaagcgttgttcggaatcactgggcgtaaagggagcgtaggcggcgtggtaagtcagatgtgaaatcccggggctcaaccccggaactgcatccgatactgccatgcttgagggttggagaggtagctggaattctcggtgtagcagtgaaatgcgtggatatcgagaggaacactcgtggcgaaggcgagctactggacaacatctgacgctgaggctcgaaggctaggggagcaaaaggg

SEQ ID NO: 1315 - DNA, 254 bp, Unknown
  Kingdom: Bacteria, Phylum: Verrucomicrobia, Class: Verrucomicrobiae, Order: Verrucomicrobiales, Family: Verrucomicrobiaceae, Genus:
atacgaaggtcccaagcgttgttcggaatcactgggcgtaaagggagcgtaggcggcgtggtaagtcagatgtgaaatcccggggctcaaccccggaactgcatccgatactgccatgcttgagggttggagaggtagctggaattctcggtgtagcagtgaaatgcgtggatatcgagaggaacactcgtggcgaaggcgagctactggacaacatctgacgctgaggctcgaaggccaggggagcaaaaggg

SEQ ID NO: 1316 - DNA, 254 bp, Unknown
  Kingdom: Bacteria, Phylum: Verrucomicrobia, Class: Verrucomicrobiae, Order: Verrucomicrobiales, Family: Verrucomicrobiaceae, Genus:
atacgaaggtcccaagcgttgttcggaatcactgggcgtaaagggagcgtaggcggcgtggtaagtcagatgtgaaatcccggggctcaaccccggaactgcatccgatactgccatgctagaggattggagaggtagctggaattcttggtgtagcagtgaaatgcgtagagatcaagaggaacactcgtggcgaaagcgagctactggacaattcctgacgctgaggctcgaaggccagggtagcgaaaggg

SEQ ID NO: 1317 - DNA, 254 bp, Unknown
  Kingdom: Bacteria, Phylum: Verrucomicrobia, Class: Verrucomicrobiae, Order: Verrucomicrobiales, Family: Verrucomicrobiaceae, Genus:
atacgaaggtcccgagcgttgttcggaatcactgggcgtaaagggagcgtaggcggcgtggtaagtcagatgtgaaatcccggggctcaaccccggaactgcatccgatactgccgtgctagaggattggagaggtagctggaattcttggtgtagcagtgaaatgcgtggagatcaagaggaacactcgtggcgaaagcgagctactggacaatatctgacgctgaggctcgaaggccagggtagcgaaaggg

SEQ ID NO: 1318 - DNA, 254 bp, Unknown
  Kingdom: Bacteria, Phylum: Verrucomicrobia, Class: Verrucomicrobiae, Order: Verrucomicrobiales, Family: Verrucomicrobiaceae, Genus:
atacgaaggtcccaagcgttgttcggaatcactgggcgtaaagggagcgtaggcggcgtggtaagtcagatgtgaaatcccggggctcaaccccggaactgcatccgatactgccatgctagaggattggagaggtagctggaattcttggtgtagcagtgaaatgcgtagagatcaagaggaacactcgtggcgaaagcgagctactggacaattcctgacgctgaggctcgaaggctagggtagcgaaaggg

SEQ ID NO: 1319 - DNA, 253 bp, Unknown
  Kingdom: Bacteria, Phylum:  , Class:  , Order:  , Family:  , Genus:
tacgtaggaggcgagcgtcgtccggagttactgggcgtaaagcgcacgcaggcggtcttttaagtctgtagggacagggcacagctcaactgtgtcaggcttacggaaactgggagacttgagggcttcagagggatggggaattccgggtggagtggtgaaatgcgtagagatccggaagaacaccaaaggcgaaggcaccatcctggggagtcactgacgctcgggtgcgaaagccaggggagcgaacggg

SEQ ID NO: 1320 - DNA, 253 bp, Unknown
  Kingdom: Bacteria, Phylum:  , Class:  , Order:  , Family:  , Genus:
tacgagtggtgcaagcgttattcggattaattgggcgtaaagggtgcgcaggcggcgcattaagtcaactgttaaatgcctcagcctaactgaggaccagcagtagatactggtgtgctagagagtggaagagagaagtggaattcttggagtagcggtaaaatgcgtagacctcaagaggaacaccaatggcgaaggcagctgcttggtccattcctgacgctcatgcacgaaagcgtggggagcaaacagg

SEQ ID NO: 1321 - DNA, 253 bp, Unknown
  Kingdom: Bacteria, Phylum:  , Class:  , Order:  , Family:  , Genus:
tacggagggggctagcgttgttcggaattactgggcgtaaagcgcacgtaggcggccgaataagtcagaggtgaaagcctggggctcaaccccagaactgcctttgagactgtatggctagaacgtcggagaggtgagtggaattccgagtgtagaggtgaaattcgtagatattcggaagaacaccagtggcgaaggcggctcactggacgactgttgacgctgaggtgcgaaagcgtggggagcaaacagg

SEQ ID NO: 1322 - DNA, 253 bp, Unknown
  Kingdom: Bacteria, Phylum:  , Class:  , Order:  , Family:  , Genus:
tacagagagtgcgagcgttaatcggaattactgggcgtaaagcgcacgtaggtggattcttaagtcagatgtgaaagccccgagcttaacttgggaattgcatttgatactgggcgtctagaatatagtagagggaagtggaatttccggtgtagcggtgaaatgcgtagatatcggaaggaacatcagtggcgaaagcggcttcctggactaatattgacacttaggtgcgaaagcgtggggagcaaacagg

SEQ ID NO: 1323 - DNA, 253 bp, Unknown
  Kingdom: Bacteria, Phylum:  , Class:  , Order:  , Family:  , Genus:
tacggggggagctagcgtttttcggaattactgggcgtaaagggcgtgtaggcggttaataaagttgaaagtgaaatccctgggcttaacctaggaactgctttcaaaactcattaactagaggacgatagaggatagtagaattcctagtgtagaggtgaaattcttagatattaggaggaataccggtggcgaaggcggctatctggatcgtttctgacgctgaggcgcgaaagcgtggggagcaaacagg

SEQ ID NO: 1324 - DNA, 253 bp, Unknown
  Kingdom: Bacteria, Phylum:  , Class:  , Order:  , Family:  , Genus:
tacagagggtgcaagcgttaatcggagttactgggcgtaaagggcgcgtaggttgatatgtaagtgagttgtgaaatccctgggcttaacctaggaactgcaacttatactgtgtatctagagtactgtagagggtagtggaatttccggtgtagcggtgaaatgcgtagagatcggaaggaacaccagtggcgaaggcggctacctggacagatactgacactgaggcgcgagagcgtgggtagcaaacagg

SEQ ID NO: 1325 - DNA, 253 bp, Unknown
  Kingdom: Bacteria, Phylum:  , Class:  , Order:  , Family:  , Genus:
tacgtagggtgcaagcattaatcggatttattgggcgtaaagggcgcgtaggcgggagggaaagtcagatgtgaaatcccgaggctcaacctcggacccgcatctgatacttcctttcttgaggatgagcggagaaaatggaattccacgtgtagcggtgaaatgcgtagatatgtggaggaacaccggtggcgaaggcgattttctagcttagacctgacgctgaggcgcgaaagcaaggggagcaaacagg

SEQ ID NO: 1326 - DNA, 253 bp, Unknown
  Kingdom: Bacteria, Phylum:  , Class:  , Order:  , Family:  , Genus:
tacagagggtgcgagcgttaatcggagttactgggcgtaaagggcgcgtaggcggatatatgagtgttatgtgaaagccctgggcttaacctgggaagtgcatagcaaacgatatatctggagtacaagagagggtggcggaatttccggtgtagcggtgaaatgcgtagagatcggaaggaacgtcgatggcgaaggcagccacctggcttgatactgacgctgaggcgcgaaagcgtggggagcgaacagg

SEQ ID NO: 1327 - DNA, 253 bp, Unknown
  Kingdom: Bacteria, Phylum:  , Class:  , Order:  , Family:  , Genus:
tacgaagggggctagcgttgttcggaatcactgggcgtaaagcgcaagtaggcggttaagtaagttgggtgtgaaatccttggtttcaagctaagaactgcattcaaaactgcataactagagtacagtagggggtaatggaattccgagtgtaggggtggaatccttagatattcggaggaacaccagtagcgaaggcgtttacctgggctgttactggcgctgagttgcgaaagcatggggagcaaacagg

SEQ ID NO: 1328 - DNA, 253 bp, Unknown
  Kingdom: Bacteria, Phylum:  , Class:  , Order:  , Family:  , Genus:
tacagagggtgcaagcgttaatcggaattactgggcgtaaagggcgcgtaggcggtgaaatgagtgggatgtgaaagccccgggcttaacctgggaagtgcatgccaaacgatttgactggagtataagagagggtggcggaatttccggtgtagcggtgaaatgcgtagagatcggaaggaacgtcaatggcgaaggcagccacctggcttaatactgacgctgaggcgcgaaagcgtggggatcaaacagg

SEQ ID NO: 1329 - DNA, 253 bp, Unknown
  Kingdom: Bacteria, Phylum:  , Class:  , Order:  , Family:  , Genus:
tacagagggtgcgagcgttaatcggaattactgggcgtaaagggcgcgtaggcggagtaatgagtgtgatgtgaaagccctgggcttaacctgggaagtgcatcgcaaacgattgctctggaatacaagagagggtggcggaatttccggtgtagcggtgaaatgcgtagagatcggaaggaacgccgatggcgaaggcagccacctggcttgatattgacgctgaggcgcgaaagcgtggggagcgaacagg

SEQ ID NO: 1330 - DNA, 253 bp, Unknown
  Kingdom: Bacteria, Phylum:  , Class:  , Order:  , Family:  , Genus:
tacgtagggcgcaagcgttgtccggaattattgggcgtaaagagcttgtaggcggtttgtcgcgtctggtgtgaaaacccatcgcttaacggtgggcttgcatcgggtacgggcaggctagagtgcagtaggggagactggaattcctggtgtagcggtggaatgcgcagatatcaggaggaacaccggtggcgaaggcgggtctctgggctgttactgacgctgagaagcgaaagcatggggagcgaacagg

SEQ ID NO: 1331 - DNA, 253 bp, Unknown
  Kingdom: Bacteria, Phylum:  , Class:  , Order:  , Family:  , Genus:
tacgagaggtgcaagcgttattcggaattattgggcgtaaagggtgcgcaggcggcatattaagtcaatcgtttaattcctcggcctaactgaggatcagcggtagaaactgataagctagagggcgagagagagaagcggaattctcggagtagcggtaaaatgcgtagatctcgagaggaacaccgatggcgaaggcagcttcttggctcgtttctgacgctcatgcacgaaagcgtggggagcaaacagg

SEQ ID NO: 1332 - DNA, 253 bp, Unknown
  Kingdom: Bacteria, Phylum:  , Class:  , Order:  , Family:  , Genus:
tacggagggtgcaagcattaatcggatttattgggcgtaaagggcgcgtaggcggtaaggaaagtcagatgtgaaattccggggctcaacctcggagcagcatctgaaacttccatacttgaggaaaagcggggaaaacggaattccacatgtagcggtgaaatgcgtagatatgtggaagaacaccggtggcgaaggcggttttctagctttttcctgacgctgaggcgcgaaagcgtggggagcaaacagg

SEQ ID NO: 1333 - DNA, 253 bp, Unknown
  Kingdom: Bacteria, Phylum:  , Class:  , Order:  , Family:  , Genus:
tacgtaggaggcgagcgttgtccggagttactgggcgtaaagcgcatgcaggcggtccaatcagtctgcagggacagggcacagcttaactgtgtcaggcctgtggaaactgttggacttgagggcttcagagggatggggaattccgggtggagtggtgaaatgcgtagagatccggaagaacaccaaaggcgaaggcaccatcctggggagtcactgacgctcggatgcgaaagctaggggagcgaacggg

SEQ ID NO: 1334 - DNA, 253 bp, Unknown
  Kingdom: Bacteria, Phylum:  , Class:  , Order:  , Family:  , Genus:
tacggagggagcgagcgttgttcggaattactgggcgtaaagcgtgcgcagacggatttccaagtcaggagtgaaatccccgggctcaacccgggaattgctcttgaaactggatgtctggagtctcggagaggttggcggaattcccagtgtagaggtgaaattcgtagatattgggaggaacaccagtggcgtaagcggccaactggacgagtactgacgctcatgcacgaaagtgtggggatcaaacagg

SEQ ID NO: 1335 - DNA, 253 bp, Unknown
  Kingdom: Bacteria, Phylum:  , Class:  , Order:  , Family:  , Genus:
tacagagggtgcaagcgttaatcggagttactgggcgtaaagggcgcgtaggcggttatatgagtgtgatgtgaaagccccgggcttaacctgggaagtgcatcgcaaacgatatgactggagtacaagagagggtggcggaatttccggtgtagcggtgaaatgcgtagagatcggaaggaacgtcaatggcgaaggcagccacctggcttgatactgacgctgaagcgcgaaagcgtggggagcgaacagg

SEQ ID NO: 1336 - DNA, 253 bp, Unknown
  Kingdom: Bacteria, Phylum:  , Class:  , Order:  , Family:  , Genus:
tacggagggggttagcgttgttcggaatgactgggcgtaaagcgcgcgtaggcggatcgcaaagtcgggggtgaaatcccggggctcaaccccggaatggccttcgagactcgcggtctggagttcgagagaggtgggtggaattccgagtgtagaggtgaaattcgtagatattcggaggaacaccagtggcgaaggcggcccactggctcgacactgacgctgaggcgcgaaagcgcggggagcaaacagg

SEQ ID NO: 1337 - DNA, 256 bp, Unknown
  Kingdom: Bacteria, Phylum:  , Class:  , Order:  , Family:  , Genus:
gacgtaggtggcgaacgttatccggaattattgggcgtaaagggtgcgtagatggcctgacaagttaacagtggtaaatcgaggctcaacctcgtggaaactgataatactgtctggctcgagtgcagaagaggttaacggaattccatgtggagcggtaaaatgcgtagatatatggaagaacaccaataacggcgaaggcagttaactattctgttactgacattgaggcacgaaagcgtggggagcaaaacgg

SEQ ID NO: 1338 - DNA, 253 bp, Unknown
  Kingdom: Bacteria, Phylum:  , Class:  , Order:  , Family:  , Genus:
tacggagggtgcaagcgttatccggaatcactgggtttaaagggtacgtaggcggcctgataagtcaggtgtgaaataccgcagcctaactgcggaactgcacttgatactgtccggcttgagtgaggtggaggtacacggaatgcatcatgtagcggtgaaatgcttagatatgatgtagaacaccgatagcgaaggcagtgtgccacacctatactgacgctgaggtacgaaagcgtggggagcgaacagg

SEQ ID NO: 1339 - DNA, 253 bp, Unknown
  Kingdom: Bacteria, Phylum:  , Class:  , Order:  , Family:  , Genus:
tacagaggtcccaagcgttgttcggatttactgggcgtaaagggagcgtaggtggcagattaagtctgacgtgaaagctctgagcttaactcagaaatggcgttagatactagtttgcttgaggattggaggggagattggaattctcggtgtagcagtgaaatgcgtagatatcgagaggaacaccagtggcgaaggcgaatctctggacaattcctgacactgatgctcgaaagctaggggagcaaacggg

SEQ ID NO: 1340 - DNA, 253 bp, Unknown
  Kingdom: Bacteria, Phylum:  , Class:  , Order:  , Family:  , Genus:
gacgaaggatgcaagcgttatccggattcattgggtttaaagggagcgtaggtggactggtaagtcagtggtgaaatctccgagcttaactcggaaattgccattgatactgtcggtcttgagtatagttgccgttggcggaatatgacatgtagtggtgaaatacatagagatgtcatagaacaccgattgcgaaggcagctgacgaaactataactgacactgaggctcgaaagtgtggggatcaaacagg

SEQ ID NO: 1341 - DNA, 183 bp, Unknown
  Kingdom: Bacteria, Phylum:  , Class:  , Order:  , Family:  , Genus:
tacgaagggggctagcgttgctcggaatgactgggcgtaaagggcgcgttggcggtttgtacagtcagatgtgaaattcctgggcttaacctgggggctgcatttgatacgtatggacttgagtgaggaagagggtcgtggaattcccagtgtagaggtgaaattcgtagatattgggaagaa

SEQ ID NO: 1342 - DNA, 254 bp, Unknown
  Kingdom: Bacteria, Phylum:  , Class:  , Order:  , Family:  , Genus:
gacgtagggtccaagcgttgtccggatttactgggcgtaaagagcgcgtaggcggctcgttaagtgtgaagtgaaatctctagggctcaacccagaaattgctttacatactggcgagctagagggatgcagaggtttgtggaattcctggtgtagcggtgaaatgcgtagatatcaggaggaacacccatggcgaaggcagcaaactgggcatcatctgacgctgaggcgcgaaagcgtgggtagcaaacagg

SEQ ID NO: 1343 - DNA, 253 bp, Unknown
  Kingdom: Bacteria, Phylum:  , Class:  , Order:  , Family:  , Genus:
tacggagggtgcaagcgttgtccggatttattgggtttaaagggtgcgtaggtggctgtttaagtcagtggtgaaagcctgcagcttaactgcgggactgccattgatactgaatagcttgagtactgatgaggtaggcggaattgatagtgtagcggtgaaatgcatagatattatcaagaacaccgattgcgaaggcagcttactaaggagttactgacactgaggcacgaaagcgtggggatcaaacagg

SEQ ID NO: 1344 - DNA, 253 bp, Unknown
  Kingdom: Bacteria, Phylum:  , Class:  , Order:  , Family:  , Genus:
tacagagggtgcaagcgttaatcggagttactgggcgtaaagggcgcgtaggtggttgtgtaagtgagacgtgaaagccccgggcttaacctgggaatgtcgtcttaaactgcatgactggagtactgtagagggtagtggaatttccggtgtagcggtgaaatgcgtagagatcggaaggaacaccagtggcgaaggcggctacctggacaaatactgacgctgatgcgcgagagcgtggggagcaaacagg

SEQ ID NO: 1345 - DNA, 253 bp, Unknown
  Kingdom: Bacteria, Phylum:  , Class:  , Order:  , Family:  , Genus:
tacagaggtctcaagcgttgttcggattcactgggcgtaaagggtgcgtaggtggccgggtaagtttgatgtgaaatctccgagcttaactcggaaattgcattgaatactatccggctagaggattggaggggaaactggaattctcggtgtagcagtgaaatgcgtagatatcgagaggaacaccagtggcgaaggcgagtttctggacaattcctgacactgaggcacgaaagctaggggagcaaacagg

SEQ ID NO: 1346 - DNA, 253 bp, Unknown
  Kingdom: Bacteria, Phylum:  , Class:  , Order:  , Family:  , Genus:
gacgaggggtgcaaacgttattcggaatgattgggcgtaaagggtgcgcaggcggtatattaagtcaactgttaaattcctcagcctaactgaggcccagcggtagatactggtatacttgagagtggaagagagaagtggaattctcggagtagcggtaaaatgcgtagatctcgagaggaacaccgatggcgaaggcagcttcttggtccatttctgacgctcatgcacgaaagcgcggggagcaaacagg

SEQ ID NO: 1347 - DNA, 253 bp, Unknown
  Kingdom: Bacteria, Phylum:  , Class:  , Order:  , Family:  , Genus:
aacgtaggtggcgagcgttatccggatttgctgggcgtaaagcgtgtgcaggcgggatggtaagtggtgtatgaaatctcccagcttagctgggaggggttatgccagactgccattctagagtgcgagagaggaacgtggaattccgggtgtagtggtggaatgcgtagagatccggaggaaccccagaggcgaaggcggcgttctggctcgcaactgacgctcagacacgacagcatggggagcgaacggg

SEQ ID NO: 1348 - DNA, 253 bp, Unknown
  Kingdom: Bacteria, Phylum:  , Class:  , Order:  , Family:  , Genus:
tacggagggtgcaagcgttgtccggatttattgggtttaaagggtgcgtaggcggtcttttaagtcagcggtgaaattactgagctcaactcggtgactgccgttgatactgattgacttgagtattgacgaagagggcggaattgaaggtgtagcggtgaaatgcatagatatcttcaagaacaccgattgcgaaggcagctctctagggaataactgacgctgaggcacgaaagcgtgggtagcaaacagg

SEQ ID NO: 1349 - DNA, 253 bp, Unknown
  Kingdom: Bacteria, Phylum:  , Class:  , Order:  , Family:  , Genus:
tacgtagggtccaagcgttaatcggaattactgggcgtaaagggcgcgtaggcggttatataagattgatgtgaaatccctgggcttaacctaggaactgcattgattactgtatgactggagtactgtagagggtagtagaatttccggtgtagcggtgaaatgcgtagagatcggaaggaataccagtggcgaaggcggctacctggacagatactgacgctgaggcgcgagagcgtggggagcaaacagg

SEQ ID NO: 1350 - DNA, 253 bp, Unknown
  Kingdom: Bacteria, Phylum:  , Class:  , Order:  , Family:  , Genus:
tacagagggtgcgagcgttaatcggaattattgggcgtaaagggcgcgtaggcggaacgataagtcagatgtgaaataccaaagctcaactttggtgctgcatttgaaactatcgatctagagggttgacggagaaaacggaattccacgtgtagcggtgaaatgcgtagatatgtggaagaacaccagtggcgaaagcggttttctagttaatacctgacgctgaggcgcgagagcaaggggatcaaacagg

SEQ ID NO: 1351 - DNA, 254 bp, Unknown
  Kingdom: Bacteria, Phylum:  , Class:  , Order:  , Family:  , Genus:
gacgtgaggtgcgagcgttatccggattcattgggcgtaaagagttgcgtaggtggatatgcgcattttgttttaaatgctatagctcaactatagtttatggcaaaatatggcgtatcttgaagaatatagaggatgctggaaccaatcgtgtagcagtgaaatgcgttgatatgattgggaacaccaaaggcgtaggcaggcatctgggtatttcttgacactgaggcacgaaagctcggggagcgaaaagg

SEQ ID NO: 1352 - DNA, 253 bp, Unknown
  Kingdom: Bacteria, Phylum:  , Class:  , Order:  , Family:  , Genus:
tacagagggtgcaagcgttaatcggagttactgggcgtaaagggcgcgtaggttgttgtttaagtttgatgtgaaagccctgggcttaacctaggaactgcattgaatactgggcgactagagtactgtagagggtagtggaatttccggtgtagcggtgaaatgcgtagagatcggaaggaacaccagtggcgaaggcggctacctggacagatactgacactgaggcgcgagagcgtggggagcaaacagg

SEQ ID NO: 1353 - DNA, 253 bp, Unknown
  Kingdom: Bacteria, Phylum:  , Class:  , Order:  , Family:  , Genus:
tacggagggtgcaagcgttaatcggatttattgggcgtaaagggcgcgtaggcggggaagtaagttagatgtgaaattctggggctcaactccaggcccgcatctaatactatttttctagaggataggtggagaaaagggaattccacgtgtagcggtgaaatgcgtagatatgtggaagaacaccggtggcgaaggcgcttttctaacttaagcctgacgctgaggcgcgaaagcgaggggagcaaacagg

SEQ ID NO: 1354 - DNA, 253 bp, Unknown
  Kingdom: Bacteria, Phylum:  , Class:  , Order:  , Family:  , Genus:
tacagagggtgcgagcgttaatcggatttactgggcgtaaagggcgcgtaggcggtcgtatgagtgtgatgtgaaagccccgggcttaacctgggaagtgcatcgcaaacgatacgactggagtaggtgagagggtggcggaatttccggtgtagcggtgaaatgcgtagagatcggaaggaacgtcaatggcgaaggcagccacctggttccatactgacgctgaggcgcgaaagcgtggggatcgaacagg

SEQ ID NO: 1355 - DNA, 253 bp, Unknown
  Kingdom: Bacteria, Phylum:  , Class:  , Order:  , Family:  , Genus:
tacagagactgcaagcgttattcggattcactgggcgtaaagggtgtgcaggcggcaaaatgtgtggagcgtgaaagcccgaagctcaacttcggaactgcactccaaactattttgctagagcattggagagagtagcagaattcacggtgtagcagtgaaatgcgtagatatcgtgaggaataccagaggcgaaggcggctacttggacaattgctgacgctcaaacacgaaagcgtggggagcaaaaggg

SEQ ID NO: 1356 - DNA, 253 bp, Unknown
  Kingdom: Bacteria, Phylum:  , Class:  , Order:  , Family:  , Genus:
tacagagggtgcgagcgttaatcggaattactgggcgtaaagggcgcgtaggcggttagttaagtgtgatgtgaaagccccgggcttaacctgggaagtgcatcgcaaactggttaactggagtatatgagagggtggcggaatttccggtgtagcggtgaaatgcgtagagatcggaaggaacgtcgatggcgaaggcagccacctggcataatactgacgctgatgcgcgaaagcgtggggagcgaacagg

SEQ ID NO: 1357 - DNA, 253 bp, Unknown
  Kingdom: Bacteria, Phylum:  , Class:  , Order:  , Family:  , Genus:
tacgaagggtgcaagcgttattcggaatcattgggcgtaaagcgcgcgcaggcggattgacaagtcaggtgtgaaatctcggggctcaacctcgaaactgcgcctgaaactgttagtctagagtgtcggagggggtaggggaatttcacgtgtaggggtaaaatccgtagagatgtgaaggaacaccgggggcgaaggcgcctacctggacgactactgacgctgaggcgcgaaagcgtggggagcaaacagg

SEQ ID NO: 1358 - DNA, 253 bp, Unknown
  Kingdom: Bacteria, Phylum:  , Class:  , Order:  , Family:  , Genus:
tacagagggtgcaagcgttaatcggaattactgggcgtaaagggcgtgtaggtggttttataagttggttgtgaaatccctgggcttaacctaggaatggcaatcaagactgtgagactagagtacggtagagggtagtggaatttccggtgtagcggtgaaatgcgtagagatcggaaggaacaccagtggcgaaggcggctacctggactgatactgacactgaggcgcgaaagcgtggggagcaaacagg

SEQ ID NO: 1359 - DNA, 253 bp, Unknown
  Kingdom: Bacteria, Phylum:  , Class:  , Order:  , Family:  , Genus:
tacggagggtgcaagcattaatcggatttattgggcgtaaagggcgcgtaggcggtcttgcaagtcagatgtgaaatttcggggctcaaccccggagctgcatttgaaactacaggactagagggtagtcggagaaaacggaattccacaagtagcggtgaaatgcgtagatatgtggaagaacaccggtggcgaaggcggttttctagattattcctgacgctaaagcgcgaaagcaaggggatcaaacagg

SEQ ID NO: 1360 - DNA, 253 bp, Unknown
  Kingdom: Bacteria, Phylum:  , Class:  , Order:  , Family:  , Genus:
tacggagggtgctagcgttaatcagaattactgggcgtaaagagcgcgtaggtggttttttaagtcagatgtgaaatccctaggcttaacctaggaactgcatttgaaactaaaagactagagtttcgtagagggaggtagaattctaggtgtagcggtgaaatgcgtagatatctggaggaatacctgtggcgaaagcggcctcctagacgggaactgacactgaggcgcgaaagcgtggggagcaaacagg

SEQ ID NO: 1361 - DNA, 253 bp, Unknown
  Kingdom: Bacteria, Phylum:  , Class:  , Order:  , Family:  , Genus:
tacggagggtgcaagcgttgtccggatttattgggtttaaagggtgcgtaggcgggtagttaagtctggttttaaagcgggtcgcttaacgatccaaggtggctggatactgattatcttgaaatcgttggaggcagccggaacgggtcgtgtagcggtgaaatgcatagagatgacccagaacaccaattgcgtaggcaggctgctacgactgatttgacgctgaggcacgagagcatggggagcaaacagg

SEQ ID NO: 1362 - DNA, 254 bp, Unknown
  Kingdom: Bacteria, Phylum:  , Class:  , Order:  , Family:  , Genus:
tacagagggtgcgagcgttgttcggaattactgggcgtaaagcgcgcgcaggcggcttcttaagtccgtcggtcaaatgccggggctcaaccccgagcgtgccgaggatactgggaggctggagacatgtagaggcaagcggaattccgggtgtagcggtggaatgcgtagagatccggaagaacaccggtggcgaaggcggcttgctgggcatgatctgacgctgaggcgcgaaagcgtggggagcgaacagg

SEQ ID NO: 1363 - DNA, 253 bp, Unknown
  Kingdom: Bacteria, Phylum:  , Class:  , Order:  , Family:  , Genus:
tacagagggtgcaagcgttaatcggaattactgggcgtaaagggcgcgtaggtggtcttgtaagtgagatgtgaaatccccgggcttaacctgggacgtgcatcttatactgtgagactggagtacaagagagggtagtggaatttccggtgtagcggtgaaatgcgtagatatcggaaggaacaccagtggcgaaggcggctacctggcttgatactgacactgaggcgcgagagcgtggggagcaaacagg

SEQ ID NO: 1364 - DNA, 253 bp, Unknown
  Kingdom: Bacteria, Phylum:  , Class:  , Order:  , Family:  , Genus:
tacgtaggtggcaagtgttgtccggatttattgggtttaaagggtgcgtaggcggttctataagtcagtggtgaaatacggcagctcaactgtcgaggtgccattgatactgtaggactagggtactgttgaggtaggcggaatggacggtgtagcggtgaaatgcttagatatcgtccagaacaccgatagcgaaggcagcttactaaagagtaactgacgctgaggcacgaaagtgtggggatcaaacagg

SEQ ID NO: 1365 - DNA, 253 bp, Unknown
  Kingdom: Bacteria, Phylum:  , Class:  , Order:  , Family:  , Genus:
tacgaggggtgcaagcgttatccggaattattgggcgtacagggcgcgtaggcggcttattaagtcttttgttaaatatcccggcctaaccgggaaacagcaacagatactggtgagcttgagggtggaagagagaagcggaattctcggagtagcggtaaaatgcgtagatctcgagaggaacaccgatggcgaaggcagcttcttggtccatacctgacgctgaggcgcgaaagcgtggggagcaaacagg

SEQ ID NO: 1366 - DNA, 253 bp, Unknown
  Kingdom: Bacteria, Phylum:  , Class:  , Order:  , Family:  , Genus:
gacgaggggtgcgaacgttattcggaatgattgggcgtaaagggtgcgtaggcggtttatcaagtcaactgttaaatttctcagcttaactgggagtatgcggtagaaactgacaaactagaggatggaagagagaagtagaattctcggagtagcggtaaaatgcgtagatctcgagaggaacaccgatggcgaaggcagcttcttggtccatttctgacgctgaggcacgaaagcgtggggagcaaacagg

SEQ ID NO: 1367 - DNA, 253 bp, Unknown
  Kingdom: Bacteria, Phylum:  , Class:  , Order:  , Family:  , Genus:
tacgaagggtgcaaacgttgctcggaatcattgggcgtaaagcgcacgtaggcggcttcaaaagtcggatgtgaaatcccgtggctcaaccatggacgtgcattcgaaactgcgaagcttgagtatggaagagggtcgcggaattcccggtgtagaggtgaaattcgtagatatcgggaggaacaccagtggcgaaggcggcgacctgggccaatactgacgctgaggtgcgaaagcgtggggagcaaacagg

SEQ ID NO: 1368 - DNA, 253 bp, Unknown
  Kingdom: Bacteria, Phylum:  , Class:  , Order:  , Family:  , Genus:
tacagaggcctcaagcgttatccggaatcattgggcgtaaagggtgtcaaggcggtcatgttagtcattcgtaaaatccgggagctcaacttccggcccgcgagtgaaacggcatgactagaggttggaagaggtgcgtggaactcacggtgtaggggtgaaatccgttgatatcgtggggaacaccaaaggcgaaggcagcgcactggtccaaatctgacgctcacacacgaaagccagggtagcgaatggg

SEQ ID NO: 1369 - DNA, 253 bp, Unknown
  Kingdom: Bacteria, Phylum:  , Class:  , Order:  , Family:  , Genus:
tacggagggtgcaagcattaatcggatttattgggcgtaaaggacgcgtaggcggtaaggtaagtcgggtgtgaaatcccggggctcaaccccggaacagcacatgaaactgcctttctagagggtaggcggagaaaacggaattccacaagtagcggtgaaatgcgtagatatgtggaagaacacctgtggcgaaagcggttttctagcttactcctgacgctgaggcgtgaaagcaaggggagcaaacagg

SEQ ID NO: 1370 - DNA, 253 bp, Unknown
  Kingdom: Bacteria, Phylum:  , Class:  , Order:  , Family:  , Genus:
tacgaagggggcgagcgttgttcggaattactgggcttaaagcgtgcgtaggcggattgaaaagtcagaagtgaaatcccggggcttaaccccggaactgcttttgaaactctcagtcttgaattcggaagaggttggcggaatacccagtgtagaggtgaaattcgcagatattgggtagaacaccggtggcgaaggcggccaactggtccgacattgacgctgaggcacgaaagcgtggggagcaaacagg

SEQ ID NO: 1371 - DNA, 253 bp, Unknown
  Kingdom: Bacteria, Phylum:  , Class:  , Order:  , Family:  , Genus:
tacgtaggcagcaagcgttgttcggagttactgggcgtaaagagtgcgtaggcggtttaccaagtctgctgtgaaatctcccggcttaactgggagggtgcggtggaaactggtaggctcgagtgtgggagaggtaagcggaattcctggtgtagcggtgaaatgcgtagatatcaggaggaacaccggtggtgtagacggcttactggaccacgactgacgctgaggcacgaaagcgtgggtagcaagcggg

SEQ ID NO: 1372 - DNA, 253 bp, Unknown
  Kingdom: Bacteria, Phylum:  , Class:  , Order:  , Family:  , Genus:
gacggagggtgcaagcgttgttcggattgactgggcgtaaagggcgtgtaggcggttgcccaagtccgatgtgaaagcccgaggcctaccctcggaagtgcatcggaaactaggcagctggagcgcgatagaggagggtagaattcctggtgtagcggtgaaatgcgtagatatcaggaggaataccggcggcgaaggcggccctctggatcgttgctgacgctgagacgcgaaagcgtggggagcaaacagg

SEQ ID NO: 1373 - DNA, 253 bp, Unknown
  Kingdom: Bacteria, Phylum:  , Class:  , Order:  , Family:  , Genus:
tacgtagggggcaagcgttgtccggacttactgggcgtaaagcgcgtgcaggcggattggtatgtgccgtgtgaaagctcccagcttgcctgggagaggtcgcggtagacagccgatctggaggctcggagaggttagtggaattcccggtgtagtggtgaaatgcgtagatatcgggaggaacaccagtggcgcaagcggctaactggccgagacctgacgctgagacgcgacggcgtggggagcaaaccgg

SEQ ID NO: 1374 - DNA, 253 bp, Unknown
  Kingdom: Bacteria, Phylum:  , Class:  , Order:  , Family:  , Genus:
aacgtaggaggcgagcgttatccggagttactgggcgtaaagcgcatgtaggcggttggataagttgcgtgtgaaagctcctggctaaactaggagaggacaggcaagactgttcggctagagggtggtagaggggcacagaattcggggtgtagcggtgaaatgtgtagagatcccgaggaataccagtggtgaagacggtgccctgggccatacctgacgctgagatgcgaaagcgtggggagcgaacggg

SEQ ID NO: 1375 - DNA, 253 bp, Unknown
  Kingdom: Bacteria, Phylum:  , Class:  , Order:  , Family:  , Genus:
tacggagggtgcaagcattgatcggaattactgggcgtaaagggcgcgtaggcggcctgaaaagtcagatgtgaaattccggggctcaaccccggagctgcatttgaaactttcaggcttgaggttagtaagggaaaacggaattccacgtgtagcggtgaaatgcgtagatatgtggaagaacaccggtggtgaagacggttttctgtgctaaacctgacgctgaggcgcgaaagctaggggagcaaacagg

SEQ ID NO: 1376 - DNA, 253 bp, Unknown
  Kingdom: Bacteria, Phylum:  , Class:  , Order:  , Family:  , Genus:
ggcagagggtgcaaacgttgttcggaattactgggcgtaaagcgcgtgtaggcggctgcgcaagtcgggcgtgaaatcccacggctcaaccgtggaagtgcactcgaaactgcgtagcttgagtcctggagaggaaggtggaatgcttggtgtagaggtgaaattcgtagatatcaagcggaacaccggtggcgaaggcgaccttctggacagtgactgacgctgagacgcgaaagcgtggggagcaaacagg

SEQ ID NO: 1377 - DNA, 253 bp, Unknown
  Kingdom: Bacteria, Phylum:  , Class:  , Order:  , Family:  , Genus:
tacgtagggtgcaaacgttgttcggaattactgggcgtaaagcgcgtgtaggcggcctcgcaagtcgggcgtgaaatcccacggctcaaccgtggaagtgcactcgaaactgcgaagctggagtcctggagaggaaggtggaatgcttggtgtagaggtgaaattcgtagatatcaagcggaacaccggtggcgaaggcgaccttctggacagtgactgacgctgagacgcgaaagcgtggggagcaaacagg

SEQ ID NO: 1378 - DNA, 253 bp, Unknown
  Kingdom: Bacteria, Phylum:  , Class:  , Order:  , Family:  , Genus:
aacgtaggagacaaacgttatccggagttactgggcgtaaagggcgtgtaggtggttgcgtaagtctggcgtgaaatttttcggcttaaccgggaaaggtcgtcggatactgcgtagctagaggacggtagaggcgtgtggaattccgggtgtagtggtgaaatgcgtagagatccggaggaacaccagtggcgaaggcgacacgctgggccgtacctgacactgatgcgcgacagcatggggagcaaacagg

SEQ ID NO: 1379 - DNA, 254 bp, Unknown
  Kingdom: Bacteria, Phylum:  , Class:  , Order:  , Family:  , Genus:
tacgagtggtgctagcgttattcggatttattgggcgtaaagggtgtgtagacggttttttaagtcacttgtttaatccttcggcctaaccgaagtacagcgagtgaaactgataaacttgagggtggaagagagaagtggaattctcggagtagcggtaaaatgcgtagatctcgagaggaacaccaatggcgaaggcagcttcttggtccatttcctgacgttgaaacacgaaagcgtggggagcaaacagg

SEQ ID NO: 1380 - DNA, 253 bp, Unknown
  Kingdom: Bacteria, Phylum:  , Class:  , Order:  , Family:  , Genus:
cacgtatggggcgagcgttgttcggaattattgggcgtaaagggtatgcaggcggtttcgtaagtctggtgtgtaagaccacagcttaactgggggaacgcattggaaactgcgaggcttgagtacaggagggggagctggaattccaggtgtaggggtgaaatctgtagatatctggaagaacatcagtggcgaaggcgagctcctggccatgtactgacgctgagatacgaaagcgtggggagcgaacagg

SEQ ID NO: 1381 - DNA, 254 bp, Unknown
  Kingdom: Bacteria, Phylum:  , Class:  , Order:  , Family:  , Genus:
atacgtagggcgcgagcgttgtccggaattattgggcgtaaagagctcgtaggcggcttgtcacgtcggttgtgaaagcccggggcttaaccccgggtctgcagtcgatacgggcaggctagagttcggtaggggagatcggaattcctggtgtagcggtgaaatgcgcagatatcaggaggaacaccggtggcgaaggcggatctctgggccgatactgacgctgaggagcgaaagcgtggggagcgaacagg

SEQ ID NO: 1382 - DNA, 253 bp, Unknown
  Kingdom: Bacteria, Phylum:  , Class:  , Order:  , Family:  , Genus:
tacggagggtgcgagcgttaatcggaattattgggcgtaaagggtgcgtaggtggtttgttaagttatctgtgaaaaccctgggcttaacctggggctgggagataagactggcagactggagtatgggagagggtagtggaatttccggtgtagcggtgaaacgcgtagagatcggaaggaacaccagtggcgaaggcggctacctggacaaatactgacgctgaggcgcgaaagcgtggggagcaaacagg

SEQ ID NO: 1383 - DNA, 253 bp, Unknown
  Kingdom: Bacteria, Phylum:  , Class:  , Order:  , Family:  , Genus:
tacagaggtcccgagcgttgttcggattcattgggcgtaaagggtgcgtaggcggcgccgtaagtcaggtgtgaaagcttggggcttaaccccaaaagagcatttgaaactgcggtgctagagtactggagaggagactggaattcacggtgtagcagtgaaatgcgtagatatcgtgaggaaggccagtggcgaaagcgggtctctggacaggtactgacgctgaggcacgaaggctaggggagcaaacggg

SEQ ID NO: 1384 - DNA, 253 bp, Unknown
  Kingdom: Bacteria, Phylum:  , Class:  , Order:  , Family:  , Genus:
tacggagggtgcaagcattgatcggaattactgggcgtaaagggcgcgtaggcggtttaataagtcggatgtgaaattccggggctcagccccggagctgcatttgaaactgttgaactagagtacagttagggtaaacggaattccacgtgtagcggtgaaatgcgtagatatgtggaagaacaccggtggtgaagacggtttactgggctgtaactgacgctgaggcgcgaaagcatggggagcaaacagg

SEQ ID NO: 1385 - DNA, 253 bp, Unknown
  Kingdom: Bacteria, Phylum:  , Class:  , Order:  , Family:  , Genus:
gacggggggtccaagcgttgttcggaatcattgggcgtaaagcgtgtgcaggtggtcttgtaagttggatgtgaaagccccgggcttaacccgggaagtgcattcaaaactgcaagacttgagtatggaagagggtcgtggaattccaggtgtagtggtgaaatacgtagatatctggaggaacaccggtggcgaaggcggcgacctggtcctatactgacactcatacacgaaagcgtgggtagcaaacagg

SEQ ID NO: 1386 - DNA, 253 bp, Unknown
  Kingdom: Bacteria, Phylum:  , Class:  , Order:  , Family:  , Genus:
tacggagggtgcaagcattaatcggacttattgggcgtaaagggcgcgtaggcggggatgtaagtcagatgtgaaatcccgaggctcaacctcggaacagcatttgaaactccatcccttgaggataggcggagaaaacggaattccacatgtagcggtgaaatgcgtagatatgtggaagaacatcggtggcgaaggcggttttctagcttaaacctgacgctgaggcgcgaaagcaaggggatcaaacagg

SEQ ID NO: 1387 - DNA, 253 bp, Unknown
  Kingdom: Bacteria, Phylum:  , Class:  , Order:  , Family:  , Genus:
tacgaagggtgcaagcgttaatcggaattactgggcgtaaagggtgcgtaggtggtttgataagttaggtgtgaaagccctgggcttaacctgggaactgcgcctaatactgttgaacttgagtactgtagaggaaggtggaatttccggtgtagcggtgaaatgcgtagatatcggaaggaacatcagtggcgaaggcgactttctggacagatactgacactgaggcacgaaagcatggggagcaaacagg

SEQ ID NO: 1388 - DNA, 253 bp, Unknown
  Kingdom: Bacteria, Phylum:  , Class:  , Order:  , Family:  , Genus:
tacagaagccccaagcattacccggaatcactgggcgtaaagggtgcgtaggcggttatattagtcgggtgttaaatcctggggctcaacctcagaatcgcattcgaaacggtataactaggagaagtgagaggtgtgcggaactcaaggtgtaggggtgaaatccgttgatatcttggggaacaccaaatgcgaaggcagcacactggcactctctcgacgctgaggcacgaaagcgtgggtagcgaatggg

SEQ ID NO: 1389 - DNA, 253 bp, Unknown
  Kingdom: Bacteria, Phylum:  , Class:  , Order:  , Family:  , Genus:
tacgaagggtgcaagcgttattcggattgattgggcgtaaagggtgcgcagacggtatgttaagtcgattgttaaatttcccagcctaactgggagcaagcggttgaaactggcaaactagaggatggaagagagaagtggaattctcggagtagcggtaaaatgcgtagatctcgaggggagcaccgatggcgaaggcagcttcttggtccatttctgacgttcatgcacgaaagcgcgggtagcaaacagg

SEQ ID NO: 1390 - DNA, 253 bp, Unknown
  Kingdom: Bacteria, Phylum:  , Class:  , Order:  , Family:  , Genus:
gacggagggggctagcgttgttcggaatgactgggcgtaaagggcgcgtaggctgttgtttaagtgaggcgtgaaagccctgggcttaacccaggaggtgcgtttcatactgaacgacttgagagcgagagaggaaagcggaattcctagtgtagaggtgaaattcgtagatattaggaagaacaccagaggcgaaggcggctttctggctcgcaactgacgctgaggcgcgaaagcgtggggagcaaacagg

SEQ ID NO: 1391 - DNA, 253 bp, Unknown
  Kingdom: Bacteria, Phylum:  , Class:  , Order:  , Family:  , Genus:
tacagggggtgcaagcgttaatcggaattactgggtgtaaagggcgcgtaggcggtgagatgagtgtggtgtgaaagccccgggcttaacctgggaagtgcatcgcaaacgatctaactggagtatatgagagggtggcggaatttccggtgtagcggtgaaatgcgtagagatcggaaggaacgtcgatggcgaaggcagccacctggcataatactgacgctgaagcgcgaaagcgtggggagcgaacagg

SEQ ID NO: 1392 - DNA, 253 bp, Unknown
  Kingdom: Bacteria, Phylum:  , Class:  , Order:  , Family:  , Genus:
tacgaagggtgcgagcgttaatcggaatgactgggtgtaaagggcgcgtaggcggtaagatgagtgtgatgtgaaagccccgggcttaacctgggaagtgcatcgcaaactatttaactagagtatatgagagggtggcggaatttccggtgtagcggtgaaatgcgtagagatcggaaggaacgtcagtggcgaaggcagccacctggcataatactgacgctgaggcgcgaaagcgtggggagcgaacagg

SEQ ID NO: 1393 - DNA, 253 bp, Unknown
  Kingdom: Bacteria, Phylum:  , Class:  , Order:  , Family:  , Genus:
aacgtaggtggcgagcgttatccggatttactgggcgtaaagcgtgtgcaggcggggtaataagtggtgtatgaaatctcccagcttaactgggaggggttatgccagactgttactctagagtgcgagagaggaacgtggaattccgggtgtagtggtgaaatgcgtagagatccggaggaaccccagaggcgaaggcggcgttctggctcgcaactgacgctcagacacgacagcatggggagcgaacggg

SEQ ID NO: 1394 - DNA, 253 bp, Unknown
  Kingdom: Bacteria, Phylum:  , Class:  , Order:  , Family:  , Genus:
tacgaaccgtgcgaacgttgttcggattcactgggcttaaagggcgcgtaggcgggttgtcaagtcgggggtgaaatctttcagctcaactggaaaagtgcctccgatactgatgacctcgagggaggtaggggcatgtggaacttccggtggagcggtgaaatgcgtagatatcggaaggaacgccggtggcgaaagcgacgtgctggatctcttctgacgctgaggcgcgaaagctaggggagcaaacggg

SEQ ID NO: 1395 - DNA, 253 bp, Unknown
  Kingdom: Bacteria, Phylum:  , Class:  , Order:  , Family:  , Genus:
tacgaggggtgcaagcgttattcggatttattgggcgtaaagggtgcgtaagtggtatgttaagtctgttgttaaattctccggcctaaccggaagcctgcaatggaaactggcgtacttgaggatggaagagggaagtggaattctcggagtagcggtaaaatgcgtggatctcgagaggaacaccgatggcgaaggcagcttcctggtccatatctgacactgaggcacgaaagcgtggggagcaaacagg

SEQ ID NO: 1396 - DNA, 253 bp, Unknown
  Kingdom: Bacteria, Phylum:  , Class:  , Order:  , Family:  , Genus:
tacgtaggtggcgagcgttgtccggatttattgggtttaaagggtgcgtaggcggccctataagtcagtggtgaaatatcgcagcttaactgtgagggtgccattgatactgtagggctcgagtgaatttgaagtaggcggaattgacggtgtagcggtgaaatgcttagatatcgtcaagaacaccgatagtgaagacagcttactaagcttcaactgacgctgaggcacgaaagtgtggggatcaaacagg

SEQ ID NO: 1397 - DNA, 253 bp, Unknown
  Kingdom: Bacteria, Phylum:  , Class:  , Order:  , Family:  , Genus:
tacggagggtgcaagcgttatccggattcactgggtttaaagggtgtgtaggcgggtatttaagtcagtggtgaaatctctgagctcaactcagaaactgccattgatactatttatcttgaatatcgttgaggttggcggaatatatcatgtagcggtgaaatgcatagatatgatatagaacaccgattgcgaaggcagctaactaagcgatgattgacgctgaggcacgaaagcgtggggatcaaacagg

SEQ ID NO: 1398 - DNA, 253 bp, Unknown
  Kingdom: Bacteria, Phylum:  , Class:  , Order:  , Family:  , Genus:
tacggagggtgcaagcattaatcggatttattgggcgtaaagggcgcgtaggcggataaggaagtcagatgtgaaatcccggggctcaaccccggaacagcatttgaaactaagtatctagagggtaggcggagaaaacggaattccacaagtagcggtgaaatgcgtagatatgtggaagaacaccggtggcgaaggcggttttctagcttaaacctgacgctgaggcgcgaaagcaaggggatcaaacagg

SEQ ID NO: 1399 - DNA, 253 bp, Unknown
  Kingdom: Bacteria, Phylum:  , Class:  , Order:  , Family:  , Genus:
tacgaagggggctagcgttgttcggaattactgggcgtaaagcgcgtgtaggcggctctgcaagtcggatgtgaaatcccacggctcaaccatggaagtgcattcgaaactgcagggctagagtcctggagaggaaggtggaatgcttggtgtagaggtgaaattcgtagatatcaagcggaacaccggtggcgaaggcggccttctggacagtgactgacgctgagacgcgaaagcgtggggagcaaacagg

SEQ ID NO: 1400 - DNA, 254 bp, Unknown
  Kingdom: Bacteria, Phylum:  , Class:  , Order:  , Family:  , Genus:
tacggagggtgcaagcattaatcggatttattgggcgtaaagagcgcgtaggctgataagtaagtcaggtgtgaaatcctggggctcaaccccagaacagcacttgaaactgctttatctagagggtaggaggagaaaacggaattccacaagtagcggtgaaatgcgtagatatgtggaagaacaccggtggcgaaggcggttttctatcttattcctgacgctgaggcgcgaaagcaaggggatcaaacagg

SEQ ID NO: 1401 - DNA, 253 bp, Unknown
  Kingdom: Bacteria, Phylum:  , Class:  , Order:  , Family:  , Genus:
tacgaagggggctagcgttgttcggatttactgggcgtaaagggcacgcaggcggcttaacaagttgggggtgaaatcccggggcttaacctcggaactgccttcaaaactgttaagctagagatcgagagaggcgagtggaattcctagtgtagaggtgaaattcgtagatattaggaggaacaccagtggcgaaggcggctcactggctcgaatctgacgctcaggtgcgaaagcgtggggagcaaacagg

SEQ ID NO: 1402 - DNA, 253 bp, Unknown
  Kingdom: Bacteria, Phylum:  , Class:  , Order:  , Family:  , Genus:
gacagagggtgcaagcgttgttcggaattattgggcgtaaagggcgcgtaggtggccgcgtaagtcggatgtgaaagcccagggcttaaccctggaagtgcatccgatactgtgtggcttgagtcccggagagggtcgtggaattcccagtgtagaggtgaaattcgtagatattgggaggaacaccagtggcgaaggcgacgacctggacgaggactgacactgaggcgcgaaagcgtggggagcaaacagg

SEQ ID NO: 1403 - DNA, 253 bp, Unknown
  Kingdom: Bacteria, Phylum:  , Class:  , Order:  , Family:  , Genus:
gacagagggtgcaaacgttgttcggaatgactgggcgtaaagcgcgtgtaggcggcctcgcaagtcgggtgtgaaagccctgggctcaacccaggaagtgcactcgaaactgcaaggcttgagttccggagaggaaagcggaattctcggtgtagaggtgaaattcgtagatatcgagaggaacaccggtggcgaaggcggctttctggacggcgactgacgctgagacgcgaaagcgtggggagcaaacagg

SEQ ID NO: 1404 - DNA, 253 bp, Unknown
  Kingdom: Bacteria, Phylum:  , Class:  , Order:  , Family:  , Genus:
tacagagggtgcgagcgttaatcggagttactgggcgtaaagggcgcgtaggcggttctataagtgagatgtgaaaggcctgggcttaacctaggaacggcatcttagactataggactagagtgcagtagagggtggcggaatttccggtgtagcggtgaaatgcgtagagatcggaaggaacaccagtggcgaaggcggccacctggactgtcactgacgctgaggcgcgagagcgtgggtagcaaacagg

SEQ ID NO: 1405 - DNA, 253 bp, Unknown
  Kingdom: Bacteria, Phylum:  , Class:  , Order:  , Family:  , Genus:
tacggagggtgcaagcgttgtccggatttattgggtttaaagggtgcgtaggtggttttttaagtctggtttgaaagctggtcgcttaacgatcagatgtggctggaaactgaggaacttgaatgcgttggcggtagccggaacgggtcatgtagcggtgaaatgcatagatatgacccagaacaccgattgcgaaggcaggctactacgacgtgattgacactgaggcacgagagcatgggtagcgaacagg

SEQ ID NO: 1406 - DNA, 253 bp, Unknown
  Kingdom: Bacteria, Phylum:  , Class:  , Order:  , Family:  , Genus:
tacgaagggggcaagcgttgctcggatttattgggcgtaaagggtgtgtaggcggctttgtaagttaggtgtgaaatcccggggcttaaccccggaactgcacttaagactgcagagcttgaagttcgaagaggttagcagaatttccagtgtagaggtgaaattcgtagatattggaaagaataccaatggcgtaggcagctaactggtcgacacttgacgctgaggcacgaaagcgtggggagcaaacagg

SEQ ID NO: 1407 - DNA, 253 bp, Unknown
  Kingdom: Bacteria, Phylum:  , Class:  , Order:  , Family:  , Genus:
tacggagggtgcaagcattaatcggatttattgggcgtaaagggcgcgtaggcggaaataaaagtcagatgtgaaatcctggggcttaaccccagaacagcatttgaaactctatttctagagggtaggaggagaaaacggaattccacaagtagcggtgaaatgcgtagatatgtggaagaacaccggtggcgaaggcggttttctatcttattcctgacgctgaggcgcgaaagcaaggggatcaaacagg

SEQ ID NO: 1408 - DNA, 253 bp, Unknown
  Kingdom: Bacteria, Phylum:  , Class:  , Order:  , Family:  , Genus:
tacggagggtgcaagcgttatccggattcactgggtttaaagggtgcgtaggcggcttgataagtcattggtgaaagctcgtggctcaaccgcgaaactgccaatgaaactgccaagcttgaatctggttgaagtgggcggaatacaacatgtagcggtgaaatgcttagatatgttgtagaacaccgattgcgaaggcagctcactaagccaacattgacgctgaggcacgaaagcgtgggtagcgaacagg

SEQ ID NO: 1409 - DNA, 253 bp, Unknown
  Kingdom: Bacteria, Phylum:  , Class:  , Order:  , Family:  , Genus:
tacggagggtgcaagcattgatcggaattactgggcgtaaagggcgcgtaggcggtttgataagtcagatgtgaaattccggggctcaaccccggagctgcatttgaaactatcaagctagaggacagttagggaaaacggaattccacatgtagcggtgaaatgcgtagatatgtggaagaacaccggtggtgaagacggttttctgggctgtaactgacgctgaggcgcgaaagctaggggagcaaacagg

SEQ ID NO: 1410 - DNA, 253 bp, Unknown
  Kingdom: Bacteria, Phylum:  , Class:  , Order:  , Family:  , Genus:
tacagagggtgcgagcgttaatcggaattactgggcgtaaagggcgcgtaggcggttagataagtgagatgtgaaatccctgggcttaacctaggaactgcatcttatactgtttagcttgagtgcagtagagggtagtggaatttccggtgtagcggtgaaatgcgtagatatcggaaggaacaccagtggcgaaggcggctacctggactgacactgacgctgaggcgcgagagcgtggggagcaaacagg

SEQ ID NO: 1411 - DNA, 253 bp, Unknown
  Kingdom: Bacteria, Phylum:  , Class:  , Order:  , Family:  , Genus:
tacagagactgcaagcgttattcggattcactgggcgtaaagggtgcgcaggcggccgtgtgtgtcagatgtgaaatcccggggcttaactccggaactgcgtctgaaactacacggctagagcattggagagggtagtggaattcacggtgtagcagtgaaatgcgtagatatcgtgaggaacaccagaggcgaaggcgactacctggacaattgctgacgctcaggcacgaaagcgtggggagccaaaggg

SEQ ID NO: 1412 - DNA, 253 bp, Unknown
  Kingdom: Bacteria, Phylum:  , Class:  , Order:  , Family:  , Genus:
tacagagggtgcaagcgttaatcggagttactgggcgtaaagggcgcgtaggtggttgtttaagtgagatgtgaaagccctgggcttaacctaggaactgcatcttatactgggcaactggagtactgtagagggtagtggaatttccggtgtagcggtgaaatgcgtagagatcggaaggaacaccagtggcgaaggcggctacctggacagatactgacactgaggcgcgagagcgtggggagcaaacagg

SEQ ID NO: 1413 - DNA, 253 bp, Unknown
  Kingdom: Bacteria, Phylum:  , Class:  , Order:  , Family:  , Genus:
tacgtaggatgcaagcgttgtccggatttactgggcgtaaagcgcgcgcaggcggcacctcaagtattcagtgaaatctccctgctcaacggggagggtgctgagtagactgaggagctagaggacggtagaggggggtagaattgctggtgtagcggtgaaatgcgtagagatcagcaggaatacccgtggcgaaggcggccccctgggccgtttctgacgctgaggtgcgaaggctaggggagcgaacggg

SEQ ID NO: 1414 - DNA, 253 bp, Unknown
  Kingdom: Bacteria, Phylum:  , Class:  , Order:  , Family:  , Genus:
gacgaaggatgcaagcgttatccggattcattgggtttaaagggagcgtaggtggtcttataagtcagtggtgaaatctcgcagcttaactgcgaaattgccattgatactgtaggacttgagtacagttgccgttggcggaatatgacatgtagtggtgaaatacatagagatgtcatagaacaccgattgcgaaggcagctaacgaaactgtaactgacactgaggctcgaaagtgcgggaatcaaacagg

SEQ ID NO: 1415 - DNA, 253 bp, Unknown
  Kingdom: Bacteria, Phylum:  , Class:  , Order:  , Family:  , Genus:
tacggagggtgcaagcgttagtcggaattactgggcgtaaagggtgcgtaggcggacaagtaagtcaattgtgaaattccgggactcaaccccggagctgcaactgaaactgcttgtctagagggatggcggagaaaacggaattccacgtgtagcggtgaaatgcgtagatatgtggaagaacacctgtggcgaaggcggttttctagcctcctcctgacgctgaggcacgaaagcaaggggagcaaacagg

SEQ ID NO: 1416 - DNA, 253 bp, Unknown
  Kingdom: Bacteria, Phylum:  , Class:  , Order:  , Family:  , Genus:
tacgtaggaggcaagcgttgtccggagttattgggcgtaaagcgcacgcaggcggtcctgtcagtctggggtgacagttcccggcttcaccgggaaagtgctctggaaactgcaggacttgagggcttcagagggatgtggaattccaggtggagtggtgaaatgcgtagggatctggaagaacaccaaaggcgaaggcagcatcctgggaagttcctgacgctcgggtgcgaaagccaggggagcgaacggg

SEQ ID NO: 1417 - DNA, 253 bp, Unknown
  Kingdom: Bacteria, Phylum:  , Class:  , Order:  , Family:  , Genus:
tacggagactgcaagcgttattcggattcactgggcgtaaagggtgcgcaggcggccaagtgtgtcaggtgtgaaatcccgaggcttaacctcggaactgcgcctgaaactacttggctagagtactggagagggtaacggaattcacggtgtagcagtgaaatgcgtagatatcgtgaggaacaccagaggcgaaggcggttacctggacagttactgacgctcaggcacgaaagcgtggggagcaaacagg

SEQ ID NO: 1418 - DNA, 253 bp, Unknown
  Kingdom: Bacteria, Phylum:  , Class:  , Order:  , Family:  , Genus:
tacgtaggtggcgaacgttatccggaattactgggcgtaaagggtctgtaggcggtcttacaggtctggcgtgacaattctcggcttaactgagagagtgcgttggaaaccggaagactagagtcacgtcgaggtcggtggaattcccggtgtagtggtggaatgcgtagagatcgggaggaacccctaaagcgaaggcagccggctagacgatgattgacgctgagggacgatagcgtggggagcgaacagg

SEQ ID NO: 1419 - DNA, 253 bp, Unknown
  Kingdom: Bacteria, Phylum:  , Class:  , Order:  , Family:  , Genus:
tacggagggtgcaagcgttaatcggaattactgggcgtaaagcgcgtgtaggcggagcgctaagtcgggcgtgaaatccccaggctcaacctgggaactgcgctcgaaactgacgttctcgagtatcggagagggtggcggaattcctggtgtagaggtgaaattcgtagatatcaggaggaacaccggtggcgaaggcggccacctggacgattactgacgctgagacgcgaaagcgtggggagcaaacagg

SEQ ID NO: 1420 - DNA, 253 bp, Unknown
  Kingdom: Bacteria, Phylum:  , Class:  , Order:  , Family:  , Genus:
tacgagaggtgcaagcgttattcggaataattgggcgtaaagggtgcgtagacggtccgctaagtctgttgttaaatctttcggcttaaccgaaaatctgcaatggaaactggtaggctagagtgtgagagagagaagtggaattcttggagtagcggtaaaatgcgtagatctcaagaggaacaccgatggcgaaggcagcttcttggctcactactgacgttgaggcacgaaagcgtggggagcaaacagg

SEQ ID NO: 1421 - DNA, 183 bp, Unknown
  Kingdom: Bacteria, Phylum:  , Class:  , Order:  , Family:  , Genus:
tacggagggggctagcgttgttcggaattactgggcgtaaagcgcacgtaggcggctattcaagtcagaggtgaaagcctggggctcaaccccagaattgcctttgagactgagtggctagaaggtgagagaggtgagtggaattccgagtgtagaggtgaaattcgtagatattcggaagaa

SEQ ID NO: 1422 - DNA, 253 bp, Unknown
  Kingdom: Bacteria, Phylum:  , Class:  , Order:  , Family:  , Genus:
tacggagggtgcgagcgttaatcggaattactgggcgtaaagggcgcgttggtggtttgttaagattgttgtgaaatccctgggcttaacctaggaactgcaacgatgactgataagcttgagtattgtagagggtagtggaatttccggtgtagcggtgaaatgcgtagagatcggaaggaacaccagtggcgaaggcggctacctggacaaatactgacactgaggcgcgagagcgtggggagcaaacagg

SEQ ID NO: 1423 - DNA, 253 bp, Unknown
  Kingdom: Bacteria, Phylum:  , Class:  , Order:  , Family:  , Genus:
tacgtagggtgcaagcgttgtccggaattattgggcgtaaagagttcgtaggcggtttgtcgcgtccgttgtgaaagcttggggctcaaccccaagtctgcagtggatacgggcagactagagtcaggtaggggagaacggaattcctggtgtagcggtgaaatgcgcagatatcaggaggaacaccggtggcgaaggcggttctctgggcctgtactgacgctgaggaacgaaagcgtggggagcgaacagg

SEQ ID NO: 1424 - DNA, 253 bp, Unknown
  Kingdom: Bacteria, Phylum:  , Class:  , Order:  , Family:  , Genus:
tacgaagggggctagcgttgctcggaattactgggcgtaaagggagcgtaggcgggttatcaagttgggggtgaaagcccggggctcaacctcggaattgccttcaaaactggtagcctagagtatgatagaggtatgtggaactccgagtgtagaggtgaaattcgtagatattcggaagaacaccagtggcgaaggcgacatactgggtcatgactgacgctgaggcgcgaaagcgtggggagcaaacagg

SEQ ID NO: 1425 - DNA, 253 bp, Unknown
  Kingdom: Bacteria, Phylum:  , Class:  , Order:  , Family:  , Genus:
tacgagtggtgcaagcgttattcggaatcactgggcgtaaagggtgtgtaggcgacatttcaagtccattgttaaatatcccagcttaactgggaaggtgcaatggaaactgatctgttagagggtggaagagagaagtggaattctcggagtagcggtaaaatgcgtagatatcgagaggaacaccgatggcgaaggcagcttcttagtccatacctgacgctgatacacgaaagcgtggggagcaaacagg

SEQ ID NO: 1426 - DNA, 253 bp, Unknown
  Kingdom: Bacteria, Phylum:  , Class:  , Order:  , Family:  , Genus:
tacagagggtgcaagcgttagtcggaattattgggcgtaaagcgcatgtaggtggttgtataagtttgatgtgaaagccctgggcttaacctgggaattgcgttgaatactgtgcaacttgagtcggacagagggcggtggaatttccggtgtagcggtgaaatgcgcagagatcggaaagaacatcggtggcgaaggcggccgcctgggtccagactgacactgaggtgcgaaagcgtggggagcaaacagg

SEQ ID NO: 1427 - DNA, 253 bp, Unknown
  Kingdom: Bacteria, Phylum:  , Class:  , Order:  , Family:  , Genus:
tacggagggtgcaagcattaatcggatttattgggcgtaaagggcgcgtaggcgggtttgtaagtcagatgtgaaatcccggggctcaacctcggaacagcatttgaaactgcatacctagagggtaggcggagaaaacggaattccacaagtagcggtgaaatgcgtagatatgtggaagaacaccggtggcgaaggcggttttctagcttactcctgacgctgaggcgcgaaagcaaggggatcaaacagg

SEQ ID NO: 1428 - DNA, 253 bp, Unknown
  Kingdom: Bacteria, Phylum:  , Class:  , Order:  , Family:  , Genus:
gacggagggtgcaagcgttgttcggattgactgggcgtaaagggcgtgtaggcggttggtcaagtctggtgtgaaagcccggggcttagcctcggaagtgcatcggaaactagccagctggagtgcgatagaggagggtggaattcctggtgtagcggtgaaatgcgtagatatcaggaggaacaccggcggcgaaggcggccctctggatcgttactgacgctgagacgcgaaagcgtggggagcaaacagg

SEQ ID NO: 1429 - DNA, 253 bp, Unknown
  Kingdom: Bacteria, Phylum:  , Class:  , Order:  , Family:  , Genus:
tacagagggtgcgagcgttaatcggagttactgggcgtaaagggcgcgtaggcggtgagatgtgtgtgatgtgaaagccccgggcttaacctgggaagtgcatcgcaaactgtttgactagagtagatgagagggtgatggaatttccggtgtagcggtgaaatgcgtagagatcggaaggaacgtcaatggcgaaggcagtcacctggcatcatactgacgctgaggcgcgaaagcgtggggagcgaacagg

SEQ ID NO: 1430 - DNA, 253 bp, Unknown
  Kingdom: Bacteria, Phylum:  , Class:  , Order:  , Family:  , Genus:
tacggagggtgcaagcattaatcggatttattgggcataaagggcgcgtaggcggaccagcaagtcagatgtgaaatcccggggctcaaccccggaacagcatttgaaactcctggtctagagggtaggcggggaaaacggaattccacaagtagcggtgaaatgcgtagatatgtggaagaacatcggtggcgaaggcggttttctagcttattcctgacgctgaggcgcgaaagcaaggggatcaaacagg

SEQ ID NO: 1431 - DNA, 253 bp, Unknown
  Kingdom: Bacteria, Phylum:  , Class:  , Order:  , Family:  , Genus:
tacgtagggggcgagcgttgtccggagttactgggcgtaaagggcgtgcaggcggtgcggtaagtttagagtgacagtatccggcttaactggataaggcctctgaaaactgccggacttgagggccagagagggacatagaattccgggtggagtggtgaaatgcgtagatatccggaggaataccaaaggcgaaggcagtgtcctggctggcaactgacgctgaggcgcgaaagctaggggagcgaacagg

SEQ ID NO: 1432 - DNA, 253 bp, Unknown
  Kingdom: Bacteria, Phylum:  , Class:  , Order:  , Family:  , Genus:
tacagagggtgcaagcgttaatcggagttactgggcgtaaagggcgcgtaggcggtttagtgggtgtgatgtgaaagccccgagcttaacttgggaagtgcatcgcaaactgttgaactggagtacaagagagggtggcggaatttccggtgtagcggtgaaatgcgtagagatcggaaggaacgtcaatggcgaaggcagccacctggcttgatactgacgctgaggcgcgaaagcgtggggagcgaacagg

SEQ ID NO: 1433 - DNA, 254 bp, Unknown
  Kingdom: Bacteria, Phylum:  , Class:  , Order:  , Family:  , Genus:
tacgaggggtgcgagcgttattcggaatcattgggcgtaaagggtgcgtaggcggcaaattaagtcagctgttaaatttcctggcctaaccaggaacatgcggtcgatactgatgtgctagaggatggaagagagaagtggaattctcggagtagcggtaaaatgcgtagatctcgagaggaacaccgatggcgaaggcagcttcttggtccatatctgacgctgagtgcacgaaagcgtggggagcaaacagg

SEQ ID NO: 1434 - DNA, 253 bp, Unknown
  Kingdom: Bacteria, Phylum:  , Class:  , Order:  , Family:  , Genus:
tacgaagggtgcaaacgttgcccggaatcattgggcgtaaagcgcacgtaggcggctccaaaagtcgcatgtgaaatccctcggctcaaccgaggacgtgcatccgaaactgcggagcttgagtatggaagagggtcgcggaatccccggtgtagaggtgaaattcgtagatatcggggggaacaccagtggcgaaggcggcgacctgggccaatactgacgctgaggtgcgaaagcgtggggagcaaacagg

SEQ ID NO: 1435 - DNA, 253 bp, Unknown
  Kingdom: Bacteria, Phylum:  , Class:  , Order:  , Family:  , Genus:
gacagagggtgcaaacgttgttcggaatcactgggcgtaaagcgcgtgtaggtggcttggcaagtcgggcgtgaaatcccggggctcaaccccggaagtgcactcgatactgcctcgctagagtcctggagaggaaggtggaatacttggtgtagaggtgaaattcgtagatatcaagtagaacaccggtggcgaaggcggccttctggacagtgactgacgctgagacgcgaaagcgtggggagcaaacagg

SEQ ID NO: 1436 - DNA, 253 bp, Unknown
  Kingdom: Bacteria, Phylum:  , Class:  , Order:  , Family:  , Genus:
tacgtagggtgcaagcgttaatcggaattactgggcgtaaagggtgtgtaggcggtttattaagtctgatgtgaaatccccgggctcaacctgggaactgcgttggatactggtaaactagagtatgtaagaggggggtggaattccacgtgtagcagtgaaatgcgtagagatgtggaggaacaccgatggcgaaggcaaccccctgggacaatactgacgctgaggcacgaaagcgtggggagcaaacagg

SEQ ID NO: 1437 - DNA, 253 bp, Unknown
  Kingdom: Bacteria, Phylum:  , Class:  , Order:  , Family:  , Genus:
gacagagggtgcaaacgttgctcggaattactgggcgtaaagcgcgtgtaggcgggccgacaagtcagatgtgaaatccctgagctcaactcaggaactgcatttgaaactgtcggccttgagtggtggagagggaagcggaattcctggtgtagaggtgaaattcgtagatatcaggaggaacaccggtggcgaaggcgacttcctggacaccaactgacgctgagacgcgaaagcgtggggagcaaacagg

SEQ ID NO: 1438 - DNA, 253 bp, Unknown
  Kingdom: Bacteria, Phylum:  , Class:  , Order:  , Family:  , Genus:
tacgaagggtgcaagcgttattcggaatcattgggcgtaaagcgcgcgcaggcggatcagcaagtcagatgtgaaatctcagagctcaactctgaaactgcgtctgaaactgctagtctagagtgtcggagggggtaggggaatttcacgtgtaggggtaaaatccgtagagatgtgaaggaacaccgggggcgaaggcgcctacctggacgactactgacgctgaggcgcgaaagcgtggggagcaaacagg

SEQ ID NO: 1439 - DNA, 253 bp, Unknown
  Kingdom: Bacteria, Phylum:  , Class:  , Order:  , Family:  , Genus:
tacggaggatccaagcgttgtccggatttattgggtttaaggggtgcgtaggcggactaataagtcagaggtgaaagccggtagctcaactatcgaattgcctttgaaactatcagtcttgagttttgttgaggtaggcggaatgtatcatgtagcggtgaaatgcatagatatgatacagaacaccgattgcgaaggcagcttactaagcaaatactgacgctgaggcacgaaagcgtggggatcaaacagg

SEQ ID NO: 1440 - DNA, 253 bp, Unknown
  Kingdom: Bacteria, Phylum:  , Class:  , Order:  , Family:  , Genus:
tacagagggtgcaagcattaatcggatttattgggcgtaaagagcgcgtaggcgggtctttaagtcagatgtgaaatacccgggctcaacccgggaactgcatttgaaactgaagatcttgagggtagtcggagaaaatggaattccacgtgtagcggtgaaatgcgtagatatgtggaagaacaccggtggcgaaggcgattttctagattatacctgacgctgaggcgcgaaagcaaggggatcaaacagg

SEQ ID NO: 1441 - DNA, 253 bp, Unknown
  Kingdom: Bacteria, Phylum:  , Class:  , Order:  , Family:  , Genus:
tacgtaggtggcgagcgttgtccggatttattgggtttaaagggtgcgtaggcggttctttaagtcagtgctgaaatactctagcttaactagaggggtggcattgatactgaggaacttgagtggagtcgaggtaggcggaattgacggtgtagcggtgaaatgcttagatatcgtcaagaacaccgatagtgtagacagcttactaaagagtaactgacgctgaggcacgaaagtgtggggatcaaacagg

SEQ ID NO: 1442 - DNA, 253 bp, Unknown
  Kingdom: Bacteria, Phylum:  , Class:  , Order:  , Family:  , Genus:
tacgaggggggcaagtgttgttcggaatcactgggcgtaaagggagcgtaggcggaagcttaagtcgggagtttaaaaccggggcccaaccccggggcggctcccgaaactgggtttcttgaatgggacagaggctggtggaattgggggtgtagcggtggaatgcgtagagatccccaagaacaccgattgcgaaggcagccagctgggtccacattgacgctgaggctcgaaagcatggggagcaaacagg

SEQ ID NO: 1443 - DNA, 253 bp, Unknown
  Kingdom: Bacteria, Phylum:  , Class:  , Order:  , Family:  , Genus:
tacgtagggtgcgagcgttgtccggatttattgggcgtaaagagctcgtaggcggttcgtcgcgtctgtcgtgaaagcccgcggctcaactgcgggtctgcggtggatacgggcggactggagtccgacaggggagactggaattcctggtgtagcggtggaatgcgcagatatcaggaggaacaccggtggcgaaggcgggtctctgggtcggtactgacgctgaggagcgaaagcgtggggagcgaacagg

SEQ ID NO: 1444 - DNA, 253 bp, Unknown
  Kingdom: Bacteria, Phylum:  , Class:  , Order:  , Family:  , Genus:
tacagagggtgcgagcgttaatcggagttactgggcgtaaagggcgcgtaggcggttgaataagatgtgtgtgaaaaccctgggcttaacctgggacgtgcatacaagactgtttgactagagtacagtagagggtagtggaatttccggtgtagcggtgaaatgcgtagatatcggaaggaacaccggtggcgaaggcggctacctgggctgatactgacgctgaggcgcgagagcgtggggagcaaacagg

SEQ ID NO: 1445 - DNA, 253 bp, Unknown
  Kingdom: Bacteria, Phylum:  , Class:  , Order:  , Family:  , Genus:
tacagaggatgcaagcgttatccggattcactgggtttaaagggtgcgtaggagggcaggtaagtcagtggtgaaatccccgagcttaacttgggaactgccgttgatactatctgtcttgaatattgtggaggtaagcggaatatgtcatgtagcggtgaaatgcttagatatgacatagaacaccaattgcgaaggcagcttgctacacaactattgactctgatgcacgaaagcgtggggatcaaacagg

SEQ ID NO: 1446 - DNA, 252 bp, Unknown
  Kingdom: Bacteria, Phylum:  , Class:  , Order:  , Family:  , Genus:
tacataggtggcaagcgttatccggatttattgggcgtatagggtgcgtaggcggtcttgcaagtttaaggttaaagcccggagctcaactccggttcgccttaaaaactgcataactagaatacaagagaggtaagtggaattccatgtgtagcggtgaaatgcgtagatatatggaggaacacctttggcgaaagcggcttactggcttgttattgacgctgaggcacgaaagcgtggggagcaaatagg

SEQ ID NO: 1447 - DNA, 253 bp, Unknown
  Kingdom: Bacteria, Phylum:  , Class:  , Order:  , Family:  , Genus:
tacgaggggggcaagtgttgttcggaatcactgggcgtaaagggagcgtaggcggatgtttaagttggatgtttaaaaccggggcccaacctcggagcggcatccaaaactggacgtcttgaatggaacagaggctagtggaattgggggtgtagcggtggaatgcgtagagatccccaagaacaccaattgcgaaggcagctagctgggttcacattgacgctgaggagcgaaagcgtggggagcgaacagg

SEQ ID NO: 1448 - DNA, 253 bp, Unknown
  Kingdom: Bacteria, Phylum:  , Class:  , Order:  , Family:  , Genus:
gacgaggggtgcaaacgttattcggaatgattgggcgtaaagggtgcgtaggcggcttattaagtcaactgttaaatttctcagcttaactgggagtatgcggtagaaactgataggctcgagggtggaagagagaagtggaattctcggagtagcggtaaaatgcgtagatctcgagaggaacaccgatggcgaaggcagcttcttggtccatttctgacgctgaggcacgaaagcgtggggagcaaacagg

SEQ ID NO: 1449 - DNA, 253 bp, Unknown
  Kingdom: Bacteria, Phylum:  , Class:  , Order:  , Family:  , Genus:
tacagagggtgcaagcgttaatcggatttactgggcgtaaagcgtgcgtaggcggttcattaagtcggttgtgaaatccctgggctcaacctgggaactgcagtcgatactggtgaactagagtgcggtagagggtggcggaactccgggtgtagcggtgaaatgcgttgatatccggaagaacaccgatggcgaaggcaaccacctgggcctgcactgacgctgaggtacgaaagcgtggggagcaaacagg

SEQ ID NO: 1450 - DNA, 252 bp, Unknown
  Kingdom: Bacteria, Phylum:  , Class:  , Order:  , Family:  , Genus:
tacagagggtgcgagcgttaatcggaattactgggcgtaaagggcgcgtaggtggtttgataagatggttgtgaaatacctggcttaacctaggaatggcaatcaagactgttagacttgagtacggtagaggatagtggaatttccggtgtagcggtgaaatgcgtagagatcggaaggaacaccagtggcgaaggcgactatctggactgatactgacactgaggcgcgaaagcgtggggagcgaacagg

SEQ ID NO: 1451 - DNA, 253 bp, Unknown
  Kingdom: Bacteria, Phylum:  , Class:  , Order:  , Family:  , Genus:
tacgaggggtgcaagcgttattcggagtgattgggtgtaaagggtgcgtaggcggtatgtttagtcaattgttaaatttctcagcttaactgggagtcggcagttgatactggcgtgctagagggtggaagagagaggtggaattctcggagtagcggtaaaatgcgtagatctcgagaggaacaccaatggcgagggcagctttttggtccattcctgacgctgaggcacgaaagcatggggagcaaacagg

SEQ ID NO: 1452 - DNA, 253 bp, Unknown
  Kingdom: Bacteria, Phylum:  , Class:  , Order:  , Family:  , Genus:
tacggagggtgcaagcgttatccggaatcattgggtttaaagggtccgcaggcggtctaataagtcagtggtgaaagcctacagctcaactgtagaactgccattgatactgtaggacttgaatgtggtcgaagtgggcgggatgtgacatgtagcggtgaaatgcatagatatgtcacagaacaccgatagcgaaggcagctcactaggccatgattgacgctcatggacgaaagcgtggggagcaaacagg

SEQ ID NO: 1453 - DNA, 253 bp, Unknown
  Kingdom: Bacteria, Phylum:  , Class:  , Order:  , Family:  , Genus:
tacggagggtgcaagcattaatcggatttattgggcgtgaagagcgcgtaggcgggaaagaaagttggatgtgaaagctcgaggctcaacctcgaaaccgcatccaaaactccttttctagaggatggacggagaaaatggaattccacgtgtagcggtgaaatgcgtagatatgtggaagaacaccagtggcgaaggcgattttctagtttattcctgacgctaatacgcgaaagcaaggggagcaaacagg

SEQ ID NO: 1454 - DNA, 252 bp, Unknown
  Kingdom: Bacteria, Phylum:  , Class:  , Order:  , Family:  , Genus:
tacgtagggggcaagcgttgtccggaattattgggcgtaaagcgcgcgcaggcggttggttaagtcttctgtttaatccccgggctcaacccgggttcgcagaggaaactgggcgactggagtgcaggagaggaaagtggaattccacgtgtagcggtgaaatgcgtagagatgtggaggaacaccagtggcgaaggcgactttctggcctgtaactgacgctgaggcgcgaaagcgtggggagcaaacagg

SEQ ID NO: 1455 - DNA, 253 bp, Unknown
  Kingdom: Bacteria, Phylum:  , Class:  , Order:  , Family:  , Genus:
tacagagggtgcaagcgttaatcggagttactgggcgtaaagggcgcgtaggcggtgatataggtgtgatgtgaaagccctgggcttaacctaggaagcgcatcgcaaacgatatgactagagtacaagagagggtggcggaatttccggtgtagcggtgaaatgcgtagagatcggaaggaacgtcgatggcgaaggcagccacctggcttgatactgacgctgaggcgcgagagcgtggggagcgaacagg

SEQ ID NO: 1456 - DNA, 253 bp, Unknown
  Kingdom: Bacteria, Phylum:  , Class:  , Order:  , Family:  , Genus:
tacgaagggtgcaagcgttattcggaatcattgggcgtaaagcgcgcgcaggcggatttgtaagtcaggtgtgaaatctcggggctcaaccccgaaactgcgcctgaaactacaagtctagaatgtcggagggggcaggggaatttcacgtgtaggggtaaaatccgtagagatgtgaaggaacaccggaggcgaaggcgcctgcctggacgactattgacgctgaggcgcgaaagcgtggggagcaaacagg

SEQ ID NO: 1457 - DNA, 253 bp, Unknown
  Kingdom: Bacteria, Phylum:  , Class:  , Order:  , Family:  , Genus:
tacgtaggtggcgagcgttgtccggatttattgggtttaaagggtgcgtaggcggttttgtaagtcagtgctgaaatatcccggcttaaccgggagggtggcattgatactgcaggacttgagtaaagttgaggtgggcggaattgacggtgtagcggtgaaatgcttagatatcgtcaagaacaccgatagtgaagacagctcactaagcttctattgacgctgaggcacgaaagtgtggggatcaaacagg

SEQ ID NO: 1458 - DNA, 253 bp, Unknown
  Kingdom: Bacteria, Phylum:  , Class:  , Order:  , Family:  , Genus:
tacgaggggtgcaagcgttattcggaatcattgggcgtaaagggtgcgtagacggcttattaagtcagctgttaaatcttccggcctaaccggaaatctgcagtagatactggtatgctagagggtggaagagagaagtggaattctcggagtagcggtaaaatgcgtagatctcgaggggaacaccaatggcgaaggcagcttcttggtccacatctgacgttgaggcacgaaagcgtggggagcaaacagg

SEQ ID NO: 1459 - DNA, 253 bp, Unknown
  Kingdom: Bacteria, Phylum:  , Class:  , Order:  , Family:  , Genus:
aacgtaggaggcaagcgttatccggagtaactgggcgtaaagggcgagtaggtggttgcgtaagttggttatgaaagctcctggctaaactgggagaggctgaccaagactgcgcgacttgagtggagaagaggttaacggaattccgcgtgtagtggtgaaatgcgtagagatgcggaagaacaccagtggcgaaggcggttaactggtctccaactgacaccgaaccgcgaaagcatgggtagcgaacggg

SEQ ID NO: 1460 - DNA, 253 bp, Unknown
  Kingdom: Bacteria, Phylum:  , Class:  , Order:  , Family:  , Genus:
aacgtaggacgcaagcgttatccggaattactgggcgtaaagcgcgtgtaggcgggtgattaagtcattggtgaaagctccgggctaaactcggagaggtccgatgatactggtcatctagagggggtcagaggggtgtggaattccgggtgtagtggtgaaatgcgtagagatccggaggaacaccagaggcgaaggcgacaccctgggaccaacctgacgctgagacgcgaaagcatggggagcgaacggg

SEQ ID NO: 1461 - DNA, 254 bp, Unknown
  Kingdom: Bacteria, Phylum:  , Class:  , Order:  , Family:  , Genus:
aacgtaggaggcgagcgttatccggatttactgggcgtaaagcgcgtgcaggcggtttggtaagttgtgcgtgaaagctcccaggctcaaccgggagaggccgtgcaagactgcccgactagaagtagagagaggccagtagaattccgggtgtagtggtgaaatgcgtagagatccggaggaataccagaagcgaaggcggctggctggctctaacttgacgctcagacgcgaaagcatggggagcgaacggg

SEQ ID NO: 1462 - DNA, 253 bp, Unknown
  Kingdom: Bacteria, Phylum:  , Class:  , Order:  , Family:  , Genus:
gacgaagggggctagcgttgttcggaattactgggcgtaaagcgcgcgcaggtggtttctcaagtcagtggtgaaagcccggagctcaactccggaactaccattgaaactgtggaactcgaggacgagagaggtgagtggaattcccagtgtagaggtgaaattcgtagatattgggaagaacaccggtggcgaaggcggctcactggctcctatctgacactcaagcgcgacagcgtggggatcaaacagg

SEQ ID NO: 1463 - DNA, 253 bp, Unknown
  Kingdom: Bacteria, Phylum:  , Class:  , Order:  , Family:  , Genus:
tacggagggtgcaagcattaatcggatttattgggcgtaaagggcgcgtaggcggggaatcaagtcagatgtgaaatcccggggctcaacctcggaactgcatttgaaactggttctcttgagggtaggcggagaaaacggaattccacaagtagcggtgaaatgcgtagatatgtggaagaacaccggtggcgaaggcggttttctagcttatacctgacgctgaggcgcgaatgcaaggggatcaaacagg

SEQ ID NO: 1464 - DNA, 254 bp, Unknown
  Kingdom: Bacteria, Phylum:  , Class:  , Order:  , Family:  , Genus:
acacgtaaggggcgagcgttgttcggaattattgggcgtaaagggcgcgtaggcggtcctgtaagcccggcgtgaaaacctggagctcaactccgggcctgcgctgggaactgcgggactagagtcatggaagggaagttggaattccaggtgtaggggtgaaatctgtagatatctggaagaacaccggtggcgaaggcgaacttctggccaatgactgacgctgaggcgcgaaagtgcggggagcaaacagg

SEQ ID NO: 1465 - DNA, 253 bp, Unknown
  Kingdom: Bacteria, Phylum:  , Class:  , Order:  , Family:  , Genus:
tacgtaggtggcgaacgttatccggagtgactgggtgtaaagggtccgtaggcgggccgttaagtctgacgtgaaagcgcccggctcaactgggcgagtgcgttggaaactgatggtcttgactcgcgcagaggtcggcggaattcccggtgtagtggtggaatgcgtagagatcgggaggaacctcgaaagcgaaggcagccgactgggggatgagtgacgctgagggacgaaagcgtggggagcgaacagg

SEQ ID NO: 1466 - DNA, 253 bp, Unknown
  Kingdom: Bacteria, Phylum:  , Class:  , Order:  , Family:  , Genus:
tacagagggtgcgagcgttaatcggagttactgggcgtaaagggcgcgtaggcggttttaagagtgtgatgtgaaagccccgggcttaacctgggaagcgcatcgcaaacgataagactggagtgcaggagagggtggcggaatttccggtgtagcggtgaaatgcgtagagatcggaaggaacgtcaatggcgaaggcagccacctggcctgacactgacgctgaggcgcgaaagcgtggggagcgaacagg

SEQ ID NO: 1467 - DNA, 253 bp, Unknown
  Kingdom: Bacteria, Phylum:  , Class:  , Order:  , Family:  , Genus:
tacagagggtgcaagcgttaatcggaatgactgggcgtaaagagtgcgtaggcggacagatgtgtcgcaggtgaaatccccgggcttaacctgggaaggtcctgcgaaactatgtgactagaatataggagagggaagtggaatttccggtgtagcggtgaaatgcgtagatatcggaaagaacaccagtggcgaaggcgacttcctggcctaatattgacgctgaggcacgaaagcgtggggagcaaacagg

SEQ ID NO: 1468 - DNA, 253 bp, Unknown
  Kingdom: Bacteria, Phylum:  , Class:  , Order:  , Family:  , Genus:
gacgaaggattcaagcgttgtccggatttactgggtttaaagggtgcgtaggcggaactttaagtcagtggtgaaagctctcggctcaaccgagaaactgccattgaaactgattttcttgaatacagttgaggtaaatggaatataacatgtagcggtgaaatgcttagatatgttatagaacaccgattgcgaaggcagtctgctaagctgttattgacgctgaggcacgaaagcgtggggagcaaacagg

SEQ ID NO: 1469 - DNA, 253 bp, Unknown
  Kingdom: Bacteria, Phylum:  , Class:  , Order:  , Family:  , Genus:
gacgaaggatccaagcgttatccggattcattgggtttaaagggagcgtaggcggatttataagtcagtggtgaaagccgatagcttaactatcgaattgccattgatactgtaggtctagagtacagatgatgttggcggaatatgacatgtagcggtgaaatgcatagatatgtcatagaacaccgattgcgaaggcagctgacaaaactgtaactgacgctgaggctcgaaagtgcggggatcaaacagg

SEQ ID NO: 1470 - DNA, 253 bp, Unknown
  Kingdom: Bacteria, Phylum:  , Class:  , Order:  , Family:  , Genus:
gacagagggtgcaaacgttgttcggaattactgggcgtaaagcgcgtgtaggcggcgacgcaagtcggatgtgaaagcccatggctcaaccatggaagtgcacccgaaactgcgtcgctagagtctcggagaggaaggtggaatgcttggtgtagaggtgaaattcgtagatatcaagcggaacaccggtggcgaaggcggccttctggacgagtactgacgctgagacgcgaaagcgtgggtagcaaacagg

SEQ ID NO: 1471 - DNA, 253 bp, Unknown
  Kingdom: Bacteria, Phylum:  , Class:  , Order:  , Family:  , Genus:
tacgagtggtgcaagcgttattcggaattattgggcgtaaagggtgtgtagacggcatgttaagtcaattgttaaattctccggcctaaccggaggccagcagtagaaactgacgtgctagagggtggaagagagaagcggaattctcggagtagcggtaaaatgcgtagatctcgagaggaacaccaatggcgaaggcagcttcttggtccatttctgacgttgaaacacgaaagcgtggggagcaaacagg

SEQ ID NO: 1472 - DNA, 253 bp, Unknown
  Kingdom: Bacteria, Phylum:  , Class:  , Order:  , Family:  , Genus:
gacgaaccgtgcaaacgttgttcggaatcactgggcttaaagggcgcgtaggcgggtggtcaagtcaggggtgaaatcctccagctcaactggagaacagcttttgatactggccatcttgaggggggtaggggcatgtggaacttccggtggagcggtgaaatgcgtagatatcggaaggaacgccggtggcgaaagcgacgtgctggaccctttctgacgctgaggcgcgaaagccaggggagcaaacggg

SEQ ID NO: 1473 - DNA, 253 bp, Unknown
  Kingdom: Bacteria, Phylum:  , Class:  , Order:  , Family:  , Genus:
tacagagggtgcaagcgttaatcggaattactgggcgtaaagggcgcgtaggcgggaaagaaagtcagatgtgaaataccggggctcaacttcggtgctgcatctgaaacttcttttctggagggtcagcggagaaaatggaattccacgtgtagcggtgaaatgcgtagatatgtggaggaacacctgtggcgaaagcggttttctagctgatttctgacgctgaggcgcgaaagcaaggggagcaaacagg

SEQ ID NO: 1474 - DNA, 253 bp, Unknown
  Kingdom: Bacteria, Phylum:  , Class:  , Order:  , Family:  , Genus:
tacgaggggtgcaagcgttatccggaattattgggcgtaaagggcgcgtaggttgcttattaagtccgttgttaaatctcccggcctaaccgggaatctgctatggatactgatgagctagaggatggaagagagaggtggaattctcggagtagcggtaaaatgcgtagatctcgagaggaacaccgatggcgaaggcagcctcttggtccattcctgacactgatgcgcgaaagcgtggggagcaaacagg

SEQ ID NO: 1475 - DNA, 253 bp, Unknown
  Kingdom: Bacteria, Phylum:  , Class:  , Order:  , Family:  , Genus:
tacagagggtgcgagcgttaatcggagttactgggtgtaaagggcgcgtaggcggcatgatgtgtgtgatgtgaaagccccgggcttaacctgggaagtgcattgcaaactattgagctagagtatgtgagagggtggcggaatttccggtgtagcggtgaaatgcgtagagatcggaaggaacgtcaatggcgaaggcagccacctggcacaatactgacgctgaggcgcgaaagcgtggggagcgaacagg

SEQ ID NO: 1476 - DNA, 253 bp, Unknown
  Kingdom: Bacteria, Phylum:  , Class:  , Order:  , Family:  , Genus:
tacagagggtgcgagcgttaatcggaatgactgggcgtaaagggcgcgtaggcggttttttaagatggttgtgaaatccctgggcttaacctaggaatggcaaccatgactggaaagctggagtactgtagagggtagtggaatttccggtgtagcggtgaaatgcgtagagatcggaaggaacaccagtggcgaaggcggctacctggacagatactgacgctgaggcgcgagagcgtggggagcaaacagg

SEQ ID NO: 1477 - DNA, 183 bp, Unknown
  Kingdom: Fungi, Phylum: Ascomycota, Class: _Sordariomycetes, Order: Hypocreales, Family: Nectriaceae, Genus:
gttggtgaaccagcggagggatcattaccgagtttacaactcccaaacccctgtgaacatacctgttttgttgcttcggcggtgccctcgctctcgcggcgaggcccgccagaggacccaaacaaactctttgactttgatctaggattatacttctgagtgatacaaaaaataaaatcaaaa

SEQ ID NO: 1478 - DNA, 197 bp, Unknown
  Kingdom: Fungi, Phylum: Ascomycota, Class: Dothideomycetes, Order: Capnodiales, Family: Davidiellaceae, Genus:
atcattacaagaaacgaccccggttttaccaccgggtgatttcataaccctttgttgtccgactctgttgcctccggggcgaccctgccttcgggcgggggctccgggtggacaaattcaaactcttgcgtaactttgcagtctgagtaaatttaattaataaattaaaactttcaacaacggatctcttggttctg

SEQ ID NO: 1479 - DNA, 193 bp, Unknown
  Kingdom: Fungi, Phylum: Ascomycota, Class: Dothideomycetes, Order: Capnodiales, Family: Davidiellaceae, Genus:
atcattacaagttgaccccggccctcgggccgggatgttcacaaccctttgttgtccgactctgttgcctccggggcgaccctgcctccgggcgggggccccgggtggacatttcaaactcttgcgtaactttgcagtctgagtaaatttaattaataaattaaaactttcaacaacggatctcttggttctg

SEQ ID NO: 1480 - DNA, 197 bp, Unknown
  Kingdom: Fungi, Phylum: Ascomycota, Class: Dothideomycetes, Order: Capnodiales, Family: Davidiellaceae, Genus:
atcattacaagtgacccccggctccggccggggatgttcataaccctttgttgtccgactctgttgcctccggggcgaccctgccttttcacgggcgggggccccgggtggacacatcaaaactcttgcgtaactttgcagtctgagtaaatttaattaataaattaaaactttcaacaacggatctcttggttctg

SEQ ID NO: 1481 - DNA, 207 bp, Unknown
  Kingdom: Fungi, Phylum: Ascomycota, Class: Dothideomycetes, Order: Capnodiales, Family: Davidiellaceae, Genus:
gtgaacctgcggagggatcattacaagaacgcccgggcttcggcctggttattcataaccctttgttgtccgactctgttgcctccggggcgaccctgccttcgggcgggggctccgggtggacacttcaaactcttgcgtaactttgcagtctgagtaaacttaattaataaattaaaacttttaacaacggatctcttggttctg

SEQ ID NO: 1482 - DNA, 203 bp, Unknown
  Kingdom: Fungi, Phylum: Ascomycota, Class: Dothideomycetes, Order: Capnodiales, Family: Davidiellaceae, Genus:
caagaaaccctacggtattactcctcggagtattgccgctaggttatttcacaaccctttgttgtccgactctgttgcctccggggcgaccctgccttcgggcgggggctccgggtggacacttcaaactcttgcgtaactttgcagtctgagtaaacttaattaataaattaaaacttttaacaacggatctcttggttctg

SEQ ID NO: 1483 - DNA, 196 bp, Unknown
  Kingdom: Fungi, Phylum: Ascomycota, Class: Dothideomycetes, Order: Capnodiales, Family: Davidiellaceae, Genus:
ggagggatcattacaagtgaccccggctacggccgggatgttcataaccctttgttgtccgactctgttgcctccggggcgaccctgccttcgggcgggggctccgggtggacacttcaaactcttgcgtaactttgcagtctgagtaaacttaattaataaattaaaacttttaacaacggatctcttggttctg

SEQ ID NO: 1484 - DNA, 175 bp, Unknown
  Kingdom: Fungi, Phylum: Ascomycota, Class: Dothideomycetes, Order: Capnodiales, Family: Mycosphaerellaceae, Genus:
ctgagtgagggccttcgggctcgacctccaaccctttgtgaacacaacttgttgcttcgggggcgaccctgccgtttcgacggcgagcgcccccggaggccttcaaacactgcatctttgcgtcggagtttaagtaaattaaacaaaactttcaacaacggatctcttggttctg

SEQ ID NO: 1485 - DNA, 184 bp, Unknown
  Kingdom: Fungi, Phylum: Ascomycota, Class: Dothideomycetes, Order: Capnodiales, Family: Mycosphaerellaceae, Genus:
ggatcattactgagtgagggccttcgggctcgacctccaaccctttgtgaacacaacttgttgcttcgggggcgaccctgccgtttcgacggcgagcgcccccggaggccttcaaacactgcatctttgcgtcggagtttaagtaaattaaacaaaactttcaacaacggatctcttggttctg

SEQ ID NO: 1486 - DNA, 216 bp, Unknown
  Kingdom: Fungi, Phylum: Ascomycota, Class: Dothideomycetes, Order: Dothideales, Family: Dothioraceae, Genus:
atcattaaagagtaagggtgctcagcgcccgacctccaaccctttgttgttaaaactaccttgttgctttggcgggaccgctcggtctcgagccgctggggattcgtcccaggcgagcgcccgccagagttaaaccaaactcttgttatttaaccggtcgtctgagttaaaattttgaatatatcaaaactttcaacaacggatctcttggttctc

SEQ ID NO: 1487 - DNA, 216 bp, Unknown
  Kingdom: Fungi, Phylum: Ascomycota, Class: Dothideomycetes, Order: Dothideales, Family: Dothioraceae, Genus:
atcattaaagagtaagggtgctcagcgcccgacctccaaccctttgttgttaaaactaccttgttgctttggcgggaccgctcggtctcgagccgctggggattcgtcccaggcgagtgcccgccagagttaaaccaaactcttgttattaaaccggtcgtctgagttaaaattttgaataaatcaaaactttcaacaacggatctcttggttctc

SEQ ID NO: 1488 - DNA, 216 bp, Unknown
  Kingdom: Fungi, Phylum: Ascomycota, Class: Dothideomycetes, Order: Dothideales, Family: Dothioraceae, Genus:
atcattaaagagtaagggtgctcagcgcccgacctccaaccctttgttgttaaaactaccttgttgctttggcgggaccgctcggtctcgagccgctggggattcgtcccaggcgagcgcccgccagagttaaaccaaactcttgttatttaaccggtcgtctgagttaaaattttgaataaatcaaaactttcaacaacggatctcttggttctc

SEQ ID NO: 1489 - DNA, 216 bp, Unknown
  Kingdom: Fungi, Phylum: Ascomycota, Class: Dothideomycetes, Order: Dothideales, Family: Dothioraceae, Genus:
atcattaaagagtaagggtgctcagcgcccgacctccaaccctttgttgttaaaactaccttgttgctttggcgggaccgctcggtctcgagccgctggggattcgtcccaggcgagcgcccgccagagttaaaccaaactcttgttattaaaccggtcgtctgagttaaaattttgaataaatcaaaactttcaacaacggatctcttggttctc

SEQ ID NO: 1490 - DNA, 213 bp, Unknown
  Kingdom: Fungi, Phylum: Ascomycota, Class: Dothideomycetes, Order: Incertae sedis, Family: Pseudeurotiaceae, Genus:
aaggatcattacagtagtcgcccgggttgccgcaaggcctcccgggtaacctaccaccctttgtttattacactttgttgctttggcaggcctgccctcgggctgctggctccggccggcgagcgcttgccagaggacctaaactctgtttgtctatactgtctgagtactatataatagttaaaactttcaacaacggatctcttggttctg

SEQ ID NO: 1491 - DNA, 191 bp, Unknown
  Kingdom: Fungi, Phylum: Ascomycota, Class: Dothideomycetes, Order: Incertae sedis, Family: Pseudeurotiaceae, Genus:
aagagacgttgcccttcggggtatacctcccaccctttgtttattatacctttgttgctttggcgggcccgtcctcggaccaccggcttcggctggtcagcgcccgccagaggacctaaaactctgtttgttcatattgtctgagtactatataatagttaaaactttcaacaacggatctcttggttctg

SEQ ID NO: 1492 - DNA, 246 bp, Unknown
  Kingdom: Fungi, Phylum: Ascomycota, Class: Dothideomycetes, Order: Pleosporales, Family: Incertae sedis, Genus: Phoma
ccttttagtacagaagcgttgtgtgggttgagttgcgcttggggagttggctacctttagctagctccttgagtggcaactcccctcataatactccctgtatatcacccttgtctttggcgcaccattgtttccttggcgggcatgcccgccaataggacaatcttataacctttttcaattttcaatcagcgtctgaaataattttaataattacaactttcaacaacggatctcttggttctg

SEQ ID NO: 1493 - DNA, 223 bp, Unknown
  Kingdom: Fungi, Phylum: Ascomycota, Class: Dothideomycetes, Order: Pleosporales, Family: Incertae sedis, Genus:
cacaataacaaggcgggctggacaccccccgctgggcactgcttcacggcgtgcgcggcggggccggccctgctgaattattcacccgtgtcttttgcgtacttcttgtttcctgggtgggctcgcccgccctcaggaccaaccacaaaccttttgcaatagcaatcagcgtcagtaacaacgtaattaattacaactttcaacaacggatctcttggttctg

SEQ ID NO: 1494 - DNA, 227 bp, Unknown
  Kingdom: Fungi, Phylum: Ascomycota, Class: Dothideomycetes, Order: Pleosporales, Family: Leptosphaeriaceae, Genus:
cattacattcagtagctcgctactgttagggaggccggttagtctgtatagtatcactactgatgagcagcacggccttctgtctgtacccttgtcttttgcgcactcatgtttcctcggctgggtttacgcccgccggctggacaactctataacctttttaattttcaatcagcgtctgaaaaacctaataattacaactttcaacaacggatctcttggttctg

SEQ ID NO: 1495 - DNA, 230 bp, Unknown
  Kingdom: Fungi, Phylum: Ascomycota, Class: Dothideomycetes, Order: Pleosporales, Family: Leptosphaeriaceae, Genus:
ggatcattacattcagtagcttgctactgttaggggggtcgatcagcctgtatagtatcactactgatgagcagcacaaccccctgtctgtacccttgtcttttgcgcactcatgtttcctcggcgggtctatgcccgccggctggacaactctataacctttttaattttcaatcagcgtctgaaaaacctaataattacaactttcaacaacggatctcttggttctg

SEQ ID NO: 1496 - DNA, 239 bp, Unknown
  Kingdom: Fungi, Phylum: Ascomycota, Class: Dothideomycetes, Order: Pleosporales, Family: Montagnulaceae, Genus:
accgttacaaacagtgtgtgctgcggcccccgaggtgaggcaacgagccttcgggaggtctggggtccgccccttcacgcgcacgcgtctgccatccttactttacgagcaccttctgttctccctcggcatgcgtcctgcgctgccgttggaattacaaaactcttttttgcatctagcattacctgttccgacaataacaatcgttacaactttcaacaatggatctcttggctctg

SEQ ID NO: 1497 - DNA, 235 bp, Unknown
  Kingdom: Fungi, Phylum: Ascomycota, Class: Dothideomycetes, Order: Pleosporales, Family: Montagnulaceae, Genus:
accgttacaaacagtgtgtgatgcggccgccgaggtgaatagcctctggttggtatggggttcgccccttcacgctcacgcgtctgccatccttactttacgagcaccttctgttctccctcggcaagggcctcgccctgccgttggaactacaaaactcttttttgcatctagcattacctgttccgacaaaaacaatcgtttacaactttcaacaatggatctcttggctctg

SEQ ID NO: 1498 - DNA, 205 bp, Unknown
  Kingdom: Fungi, Phylum: Ascomycota, Class: Dothideomycetes, Order: Pleosporales, Family: Phaeosphaeriaceae, Genus:
tttactactgtaaaaggggctgttagtctgtatagcgcaagctgatgagcagctggcctcttttatccacccttgtcttttgcgtacccacgtttcctcggcaggcttgcctgccggttggacaaatttataacctttttaattttcaatcagcgtctgaaaaacttaataattacaactttcaacaacggatctcttggttctg

SEQ ID NO: 1499 - DNA, 217 bp, Unknown
  Kingdom: Fungi, Phylum: Ascomycota, Class: Dothideomycetes, Order: Pleosporales, Family: Phaeosphaeriaceae, Genus:
tacactcagtagtttactactgtaaaggaggctgttagtctgtatagcgcaagctgatgagcagctggcctcttttatctacccttgtcttttgcgtacccacgtttcctcggcaggcttgcctgccgattggaccaacctataacctttttaattttcaatcagcgtctgaaaaacttaataattacaactttcaacaacggatctcttggttctg

SEQ ID NO: 1500 - DNA, 221 bp, Unknown
  Kingdom: Fungi, Phylum: Ascomycota, Class: Dothideomycetes, Order: Pleosporales, Family: Phaeosphaeriaceae, Genus:
caattcagtagcttgctactggtcgggaggtgctgtaagtccgcatagtttaattactgatgagcggcaagccctctgtctgtacccttgtcttttgcgcactcatgtttcctcggcgggcttgcccgccgactggacaaacttataacctttttaattttcaatcagcgtctgaaaaaacttaataattacaactttcaacaacggatctcttggttctg

SEQ ID NO: 1501 - DNA, 217 bp, Unknown
  Kingdom: Fungi, Phylum: Ascomycota, Class: Dothideomycetes, Order: Pleosporales, Family: Phaeosphaeriaceae, Genus:
  misc_feature (32)..(32): n is a, c, g, or t
attatcggtagtttactaccgtttgaaggggntggaaagtttccaggtcttcctgggggtgagtacatcctattcttaacccttgactttttgcgcactcatgtttcctcggtgggcttgcctgccgaatggacaaaccaataacctttttaatatttaatcagcgtctgaattattttaataattacaactttcaacaacggatctcttggttctg

SEQ ID NO: 1502 - DNA, 191 bp, Unknown
  Kingdom: Fungi, Phylum: Ascomycota, Class: Dothideomycetes, Order: Pleosporales, Family: Pleosporaceae, Genus:
cacaaattaaaatatgaaggcttcggctggattatttttatcacccttgtcttttgcgcacttgttgtttcctgggcgggttcgcccgccaccaggaccacaccataaaccttttttatgcagttgcaatcagcgtcagtataacaaatgtaaatcatttacaactttcaacaacggatctcttggttctg

SEQ ID NO: 1503 - DNA, 250 bp, Unknown
  Kingdom: Fungi, Phylum: Ascomycota, Class: Dothideomycetes, Order: Pleosporales, Family: Pleosporaceae, Genus:
gtaggtgaacctgcggagggatcattacacaataacaaggcgggctggccacccccagccgggcactgcttcccggcgtgcgcggctgggccggccctgctgaattattcacccgtgtcttttgcgtacttcttgtttcctgggtgggctcgcccgccatcaggaccaaccacaaaccttttgcaatagcaatcagcgtcaggaacaacgtaattaattacaactttcaacaacggatctcttggttctg

SEQ ID NO: 1504 - DNA, 204 bp, Unknown
  Kingdom: Fungi, Phylum: Ascomycota, Class: Dothideomycetes, Order: Pleosporales, Family: Pleosporaceae, Genus:
cacaatatgaaagcgggttgggacctcactttggtgagggctccagctcgtctgaattattcacccatgtcttttgcgcacttcttgtttcctgggcgggttcgcccgccaccaggaccaaaccataaacctttttgtaattgcaatcagcgtcagtaaacaatgtaattattacaactttcaacaacggatctcttggttctg

SEQ ID NO: 1505 - DNA, 191 bp, Unknown
  Kingdom: Fungi, Phylum: Ascomycota, Class: Dothideomycetes, Order: Pleosporales, Family: Pleosporaceae, Genus:
cacaataaaatacgaaggccgttcgcggctggactatttattacccttgtcttttgcgcacttgttgtttcctgggcgggttcgctcgccaccaggaccacaatataaaccttttttatgcagttgcaatcagcgtcagtataacaaatgtaaatcatttacaactttcaacaacggatctcttggttctg

SEQ ID NO: 1506 - DNA, 203 bp, Unknown
  Kingdom: Fungi, Phylum: Ascomycota, Class: Dothideomycetes, Order: Pleosporales, Family: Pleosporaceae, Genus:
cacaacaaaatatgaaggcctggctttcgcggccggctgaagtatttttttcacccatgtcttttgcgcacttgttgtttcctgggcgggttcgcccgccaccaggaccaaaccataaacctttttttcttatgcagtttccatcagcgtcagtaaaaacaatgtaattattacaactttcaacaacggatctcttggttctg

SEQ ID NO: 1507 - DNA, 208 bp, Unknown
  Kingdom: Fungi, Phylum: Ascomycota, Class: Dothideomycetes, Order: Pleosporales, Family: Pleosporaceae, Genus:
cacaaatatgaaggcagattgggtagtccccgctttggggggtttgcccattctggcgccatattcacccatgtcttttgcgtactacttgtttccttggcgggctcgcccgccaattggactttattcaaacctttttttattgcaatcagcgtcagcaaaacaatgtaatcaattacaactttcaacaacggatctcttggttctg

SEQ ID NO: 1508 - DNA, 195 bp, Unknown
  Kingdom: Fungi, Phylum: Ascomycota, Class: Dothideomycetes, Order: Pleosporales, Family: Pleosporaceae, Genus:
cacaatacaatatgaaggcccgtaacacggctggattattttattacccttgtcttttgcgcacttgttgtttcctgggcgggtttcgcccgccaccaggaccacaccataaaccttttttatgcagttgcaatcagcgtcagtacaacaaatgtaaatcatttacaactttcaacaacggatctcttggttctg

SEQ ID NO: 1509 - DNA, 191 bp, Unknown
  Kingdom: Fungi, Phylum: Ascomycota, Class: Dothideomycetes, Order: Pleosporales, Family: Pleosporaceae, Genus:
atatgaaagcgggctggcatccttcggggttacagccttgctgaattattcacccgtgtcttttgcgtacttcttgtttccttggtgggttcgcccaccataggacaaaccataaacctttttgtaattgcaatcagcgtcagtaaaaaaattaataattacaacttttaacaacggatctcttggttctg

SEQ ID NO: 1510 - DNA, 253 bp, Unknown
  Kingdom: Fungi, Phylum: Ascomycota, Class: Dothideomycetes, Order: Pleosporales, Family: Pleosporaceae, Genus:
gtaggtgaacctgcggagggatcattacacaatatgaaggcgggctggacaccctccagccgggcactgcttcacggcgtgcgcggctggagccggccctgctgaattattcacccgtgtcttttgcgtacttcttgtttcctgggtgggctcgcccgccatcaggaccaaccataaacctttttgtaatagcaatcagcgtcagtaacaacgtaattaattacaactttcaacaacggatctcttggttctg

SEQ ID NO: 1511 - DNA, 200 bp, Unknown
  Kingdom: Fungi, Phylum: Ascomycota, Class: Dothideomycetes, Order: Pleosporales, Family: Pleosporaceae, Genus:
cacaacaaaatatgaaggcctggctttgcggccggctgaaatatttttttcacccatgtcttttgcgcacttgttgtttcctgggcgggttcgcccgccaccaggaccaaaccataaaccttttttttatgcagttgcaatcagcgtcagtataaacaatgtaattattacaactttcaacaacggatctcttggttctg

SEQ ID NO: 1512 - DNA, 236 bp, Unknown
  Kingdom: Fungi, Phylum: Ascomycota, Class: Dothideomycetes, Order: Pleosporales, Family: Pleosporaceae, Genus:
gtaggtgaacctgcggagggatcattacacaatatgaaagcgggctggactcacctcagcagcatctgctgttggggccagccttgctgaattattcacccgtgtcttttgcgtacttcttgtttccttggtgggctcgcccaccacaaggacaaaccataaaccttttgtaattgcaatcagcgtcagtaacaacataataattacaactttcaacaacggatctcttggttctg

SEQ ID NO: 1513 - DNA, 207 bp, Unknown
  Kingdom: Fungi, Phylum: Ascomycota, Class: Dothideomycetes, Order: Pleosporales, Family: Pleosporaceae, Genus:
cacaacaaaaatatgagggtgtggtttgctggcaacagcgtccgccccaagtatttttcacccatgtcttttgcgcactttttgtttcctgggcgagttcgctcgccaccaggacccaaccataaacctttttttatgcagttgcaatcagcgtcagtataataattcaatttattaaaactttcaacaacggatctcttggttctg

SEQ ID NO: 1514 - DNA, 252 bp, Unknown
  Kingdom: Fungi, Phylum: Ascomycota, Class: Dothideomycetes, Order: Pleosporales, Family: Pleosporaceae, Genus:
gtaggtgaacctgcggagggatcattacacaataacaaggcgggctggacacccccagccgggcactgcttcacggcgtgcgcggctgggccggccctgctgaattattcacccgtgtcttttgcgtacttcttgtttcctgggtgggctcgcccgccatcaggaccaaccacaaacctttttgtaatagcaatccgcgtcagtaaacaatgtaatcaattacaactttcaacaacggatctcttggttctg

SEQ ID NO: 1515 - DNA, 251 bp, Unknown
  Kingdom: Fungi, Phylum: Ascomycota, Class: Dothideomycetes, Order: Pleosporales, Family: Pleosporaceae, Genus:
gtaggtgaacctgcggagggatcattacacaataaacatatgaaggctgcaccgccaacaggcggcaaggctggagtattttattacccttgtcttttgcgcacttgttgtttcctgggcgggttcgcccgcctccaggaccacatgataaaccttttttatgcagttgcaatcagcgtcagtacaacaaatgtaaatcatttacaactttcaacaacggatctcttggttctggcatcgatgaagaacgc

SEQ ID NO: 1516 - DNA, 248 bp, Unknown
  Kingdom: Fungi, Phylum: Ascomycota, Class: Dothideomycetes, Order: Pleosporales, Family: Pleosporaceae, Genus:
gtaggtgaacctgcggaaggatcattacaattcagtagcttgctactgtcgggaggcgctgtaagtccgcatagtttacttactgatgagcggcaggccctctgtctgtacccttgtcttttgcgcactcatgtttcctcggcgggcttgcccgccgattggacaaaacttataacctttttaattttcaatcagcgtctgaaaaaacttaataattacaactttcaacaacggatctcttggttctg

SEQ ID NO: 1517 - DNA, 226 bp, Unknown
  Kingdom: Fungi, Phylum: Ascomycota, Class: Dothideomycetes, Order: Pleosporales, Family: Pleosporaceae, Genus:
cacaaaaaatatgaaggctgtatgcggctgtgtctctttcggggggccagcttttgcggaggctgaaatatttttcacccatgtcttttgcgcacttgttgtttcctgggcgggtttcgcccgccaccaggaccacaccataaaccttttttatgcagttgcaatcagcgtcagtataacaaatgtaaatcatttacaactttcaacaacggatctcttggttctg

SEQ ID NO: 1518 - DNA, 211 bp, Unknown
  Kingdom: Fungi, Phylum: Ascomycota, Class: Dothideomycetes, Order: Pleosporales, Family:  , Genus:
cttgctactgttaggggggtctattagtctgtatagtatcactactgatgagcagcacgaccctctgtctatacccttgtcttttgcgcactcatgtttcctcggcggctttatacccgccggctggatcaatctataacctttttaattttcaatcagcgtctgaaaaacctaataattacaactttcaacaacggatctcttggttctg

SEQ ID NO: 1519 - DNA, 221 bp, Unknown
  Kingdom: Fungi, Phylum: Ascomycota, Class: Dothideomycetes, Order: Pleosporales, Family:  , Genus:
cacaataacatatgaaggctgtacgcggctgtgccctcgggccagtttggcggaggctggagtatttattacccttgtcttttgcgcacttgttgtttcctgggcgggtccgcccgccaccaggaccacatgataaacctttttttatgcagttgcaatcagcgtcagtacaacaaatgtaaaatcatttacaactttcaacaacggatctcttggttctg

SEQ ID NO: 1520 - DNA, 181 bp, Unknown
  Kingdom: Fungi, Phylum: Ascomycota, Class: Dothideomycetes, Order: Pleosporales, Family:  , Genus:
caaaataatcccggtgcttcggcgctgacttatttacaccctttgcctatgtgtacccctatcgcttcctcggcaggcttgcctgccgccaggaaccaaccaaaccctttgcattatatacaaaaacttctgacaacaaactaaataatcaaaactttcaacaatggatctcttggttctg

SEQ ID NO: 1521 - DNA, 243 bp, Unknown
  Kingdom: Fungi, Phylum: Ascomycota, Class: Dothideomycetes, Order: Pleosporales, Family:  , Genus:
acctttcaaatcagggtgcggcgcggcccccgaggagcggaaacaatccttgggaggtatgcgggggcttcgagccccccatttacgcacgcacgactgccatccttactttacgagcaccttctgttctccctcggcggggcaacctgccgttggaaccgaataaactctttttgcatctagcattacctgttccgaaacaaacaatcgttacaactttcaacaatggatctcttggctctg

SEQ ID NO: 1522 - DNA, 194 bp, Unknown
  Kingdom: Fungi, Phylum: Ascomycota, Class: Dothideomycetes, Order: Pleosporales, Family:  , Genus:
cacaaatatgaaggcgggctggaacctctcggggttacagccttgctgaattattcacccttgtcttttgcgtacttcttgtttccttggtgggttcgcccaccactaggacaaacataaaccttttgtaattgcaatcagcgtcagtaacaaattaataattacaactttcaacaacggatctcttggttctg

SEQ ID NO: 1523 - DNA, 178 bp, Unknown
  Kingdom: Fungi, Phylum: Ascomycota, Class: Dothideomycetes, Order:  , Family:  , Genus:
ccgagtttacaactcccaaacccctgtgaacatacctatacgttgcctcggcggatcagcccgcgccccgtaaaacgggacggcccgcccgaggacccctaaactctgtttttagtggaacttctgagtaaaacaaacaaataaatcaaaactttcaacaacggatctcttggttctg

SEQ ID NO: 1524 - DNA, 189 bp, Unknown
  Kingdom: Fungi, Phylum: Ascomycota, Class: Dothideomycetes, Order:  , Family:  , Genus:
gatcattacctttcagtatggagtttatagtccgctatagctcctgtctgtatccatgtcttttgcgtactacatgtttcctcggcgggtctgacccgccgattggacaactttaaactctttgcaattgcaatcagcgtctgaaaaaaataatagttacaactttcaacaacggatctcttggttctg

SEQ ID NO: 1525 - DNA, 226 bp, Unknown
  Kingdom: Fungi, Phylum: Ascomycota, Class: Dothideomycetes, Order:  , Family:  , Genus:
cactcagtagattctctactgctcagggagaggggaaagtttccagcatgcttcggcggctggtgacgagtacgctctctatctgaacccttgtctttttgtgtactcttgtttcctcggcgggcctgcccgccggctggacaactctataaccttttttaattctcaatcagcgtctgaataaatataataattacaactttcaacaacggatctcttggttctg

SEQ ID NO: 1526 - DNA, 212 bp, Unknown
  Kingdom: Fungi, Phylum: Ascomycota, Class: Dothideomycetes, Order:  , Family:  , Genus:
aatgaaaagctggtttaccagtatacggcccctgggtttgtttctgacaagcgccaggatcagtcgtcatttatacccatgttttttgcgtactacttgtttccttggtaggcttgcctaccattaggaccacataaaaccttttgtaattgcagtcagcgtcagaaataacttaatagttacaactttcaacaacggatctcttggttctg

SEQ ID NO: 1527 - DNA, 251 bp, Unknown
  Kingdom: Fungi, Phylum: Ascomycota, Class: Eurotiomycetes, Order: Eurotiales, Family: Aspergillaceae, Genus:
gtaggtgaacctgcggaaggatcattaccgagtgagggccctctgggtccaacctcccacccgtgtttatcatacctagttgcttcggcgggcccgccgtcatggccgccggggggcacccgcccccgggcccgcgcccgccgaagcccccctgaacgctgtctgaagattgcagtctgagcgattagctaaatcagttaaaactttcaacaacggatctcttggttccggcatcgatgaagaacgcagca

SEQ ID NO: 1528 - DNA, 219 bp, Unknown
  Kingdom: Fungi, Phylum: Ascomycota, Class: Eurotiomycetes, Order: Eurotiales, Family: Trichocomaceae, Genus: Aspergillus
tgagggccctctgggtccaacctcccacccgtgtctatcgtaccttgttgcttcggcgggcccgccgtttcgacggccgccggggaggcctcgcgcccccgggcccgcgcccgccgaagaccccaacatgaactctgttctgaaagtatgcagtctgagttgattatcataatcagttaaaactttcaacaacggatctcttggttccggcatcgatga

SEQ ID NO: 1529 - DNA, 207 bp, Unknown
  Kingdom: Fungi, Phylum: Ascomycota, Class: Eurotiomycetes, Order: Eurotiales, Family: Trichocomaceae, Genus:
ccgagtgcgggccctcgtggcccaacctcccacccttgtctctatacacctgttgctttggcgggcccaccggggccacctggtcgccgggggacatctgtccccgggcccgcgcccgccgaagcgctctgtgaaccctgatgaagatgggctgtctgagtactatgaaaattgtcaaaactttcaacaatggatctcttggttccg

SEQ ID NO: 1530 - DNA, 228 bp, Unknown
  Kingdom: Fungi, Phylum: Ascomycota, Class: Eurotiomycetes, Order: Eurotiales, Family: Trichocomaceae, Genus:
cattaccgagtgagggccctttgggtccaacctcccacccgtgtttatcgtaccttgttgcttcggcgggcccgcctcacggccgccgggggcatctgcccccgggcccgcgcccgccgaagacaccattgaacgctgtctgaagattgcagtctgagcatcttagctaaatcagttaaaactttcaacaacggatctcttggttccggcatcgatgaagaacgcagc

SEQ ID NO: 1531 - DNA, 224 bp, Unknown
  Kingdom: Fungi, Phylum: Ascomycota, Class: Eurotiomycetes, Order: Eurotiales, Family: Trichocomaceae, Genus:
ccgagtgagggccctctgggtccaacctcccacccgtgtttattttaccttgttgcttcggcgggcccgccttaactggccgccggggggcttacgcccccgggcccgcgcccgccgaagacaccctcgaactctgtctgaagattgtagtctgagtgaaaatataaattatttaaaactttcaacaacggatctcttggttccggcatcgatgaagaacgcag

SEQ ID NO: 1532 - DNA, 203 bp, Unknown
  Kingdom: Fungi, Phylum: Ascomycota, Class: Eurotiomycetes, Order: Eurotiales, Family: Trichocomaceae, Genus:
accgagtgagggccctctgggtccaacctcccacccgtgtttatttaccttgttgcttcggcgagcctgccttttggctgccgggggacgtcagtccccgggtccgtgctcgccggagacaccttagaactctgtctgaagattgtagtctgagattaaatataaattatttaaaactttcaacaacggatctcttggttccg

SEQ ID NO: 1533 - DNA, 185 bp, Unknown
  Kingdom: Fungi, Phylum: Ascomycota, Class: Eurotiomycetes, Order: Eurotiales, Family: Trichocomaceae, Genus:
caagtgaccccggtctaaccaccgggatgttcataaccctttgttgtccgactctgttgcctccggggcgaccctgccttcgggcgggggctccgggtggacacttcaaactcttgtgtaactttgcagtctgagtaaacttaattaataaattaaaacttttaacaacggatctcttggttctg

SEQ ID NO: 1534 - DNA, 235 bp, Unknown
  Kingdom: Fungi, Phylum: Ascomycota, Class: Eurotiomycetes, Order: Eurotiales, Family: Trichocomaceae, Genus:
aaggatcattaccgagtgcgggccctcgtggcccaacctcccacccttgtctctatacacctgttgctttggcgggcccaccggggtcacctggtcgccgggggacaatctgtccccgggcccgcgcccgccgaagcgctctgtgaaccctgatgaagatgggctgtctgagtactatgaaaattgtcaaaactttcaacaatggatctcttggttccggcatcgatgaagaacg

SEQ ID NO: 1535 - DNA, 205 bp, Unknown
  Kingdom: Fungi, Phylum: Ascomycota, Class: Eurotiomycetes, Order: Eurotiales, Family: Trichocomaceae, Genus:
ccgagtgagggccctctgggtccaacctcccacccgtgtttattttaccttgttgcttcggcgggcccgccttaactggccgccggggggctcacgcccccgggcccgcgcccgccgaagacaccctcgaactctgtctgaagattgaagtctgagtgaaaatataaattatttaaaactttcaacaacggatctcttggttccg

SEQ ID NO: 1536 - DNA, 199 bp, Unknown
  Kingdom: Fungi, Phylum: Ascomycota, Class: Eurotiomycetes, Order: Eurotiales, Family: Trichocomaceae, Genus:
ctgagtgagggtccctcggggcccaacctcccacccgtgtataccgtaccttgttgcttcggcgagcccgcccccccgtccttcgggggagcacagcgctcgccggagacaccaacgtgaacactgtctgaagttttgtcgtctgagtcgattgtatcgcaatcagttaaaactttcaacaacggatctcttggttccg

SEQ ID NO: 1537 - DNA, 205 bp, Unknown
  Kingdom: Fungi, Phylum: Ascomycota, Class: Eurotiomycetes, Order: Eurotiales, Family: Trichocomaceae, Genus:
ccgagtgcgggccctcgcggcccaacctcccacccttgtcctatacacctgttgctttggcgggcccaccggggccacctggtcgccgggggacgcacgtccccgggcccgcgcccgccgaagcgctctgtgaaccctgatgaagatgggctgtctgagagtatgaaaattgtcaaaactttcaacaatggatctcttggttccg

SEQ ID NO: 1538 - DNA, 202 bp, Unknown
  Kingdom: Fungi, Phylum: Ascomycota, Class: Eurotiomycetes, Order: Eurotiales, Family: Trichocomaceae, Genus:
cgagtgagggccctctgggtccaacctcccacccgtgtttattttaccttgttgcttcggcgagcctgccttttggctgccgggggacgtctgtccccgggtccgcgctcgccgaagacaccttagaactctgtctgaagattgtagtctgagattaaatataaattatttaaaactttcaacaacggatctcttggttccg

SEQ ID NO: 1539 - DNA, 183 bp, Unknown
  Kingdom: Fungi, Phylum: Ascomycota, Class: Eurotiomycetes, Order: Eurotiales, Family: Trichocomaceae, Genus:
aaggatcattaccgagtgcgggccctctgggtccaacctcccatccgtgtctatctgtaccctgttgcttcggcgtggccacggcccgccgaagactaacatttgaacactgtctgaagtttgcagtctgagtttttagttaaacaataattaaaactttcaacaacggatctcttggttccg

SEQ ID NO: 1540 - DNA, 211 bp, Unknown
  Kingdom: Fungi, Phylum: Ascomycota, Class: Eurotiomycetes, Order: Eurotiales, Family: Trichocomaceae, Genus:
atcattaccgagtgcgggcctcgcggcccaacctcccacccttgtcctatacacctgttgctttggcgggcccaccggggccacctggtcgccgggggacgcacgtctccgggcccgcgcccgccgaagcgctctgtgaaccctgatgaagatgggctgtctgagactgtgaaaattgtcaaaactttcaacaatggatctcttggttccg

SEQ ID NO: 1541 - DNA, 224 bp, Unknown
  Kingdom: Fungi, Phylum: Ascomycota, Class: Eurotiomycetes, Order: Eurotiales, Family: Trichocomaceae, Genus:
ccgagtgcgggtcctttgggcccaacctcccatccgtgtctattataccctgttgcttcggcgggcccgccgcttgtcggccgccgggggggcgcctttgccccccgggcccgtgcccgccggagaccccaacacgaacactgtctgaaagcgtgcagtctgagttgattgaatgcaatcagttaaaactttcaacaatggatctcttggttccggcatcgatg

SEQ ID NO: 1542 - DNA, 219 bp, Unknown
  Kingdom: Fungi, Phylum: Ascomycota, Class: Eurotiomycetes, Order: Eurotiales, Family: Trichocomaceae, Genus:
aaggatcattaccgagtgcgggcccctcgtggcccaacctcccacccttgtctctatacacctgttgctttggcgggcccaccggggccacctggtcgccgggggacgttcgtccccgggcccgcgcccgccgaagcgctctgtgaaccctgatgaagatgggctgtctgagtactatgaaaattgtcaaaactttcaacaatggatctcttggttccg

SEQ ID NO: 1543 - DNA, 202 bp, Unknown
  Kingdom: Fungi, Phylum: Ascomycota, Class: Eurotiomycetes, Order: Eurotiales, Family: Trichocomaceae, Genus:
ccgagtgagggccctctgggtccaacctcccacccgtgtttattttaccttgttgcttcggcgagcctgccttcgggctgccggggggcatctgcccccgggtccgcgctcgccggagacaccttgaactctgtctgaagattgtagtctgagacaaaatataaattatttaaaactttcaacaacggatctcttggttccg

SEQ ID NO: 1544 - DNA, 234 bp, Unknown
  Kingdom: Fungi, Phylum: Ascomycota, Class: Eurotiomycetes, Order: Eurotiales, Family: Trichocomaceae, Genus:
aggatcattaccgagtgagggccctctgggtccaacctcccacccgtgtttatttaccttgttgcttcggcgagcccgcctcacggccgccggggggcacccgcccccgggcccgcgcccgccgaagacaccattgaactctgtctgaagattgcagtctgagcgattagctaaatcagttaaaactttcaacaacggatctcttggttccggcatcgatgaagaacgcagcga

SEQ ID NO: 1545 - DNA, 217 bp, Unknown
  Kingdom: Fungi, Phylum: Ascomycota, Class: Eurotiomycetes, Order: Eurotiales, Family: Trichocomaceae, Genus:
aaggatcattaccgagtgagggccctctgggtccaacctcccacccgtgtttatcgtaccttgttgcttcggcgggcccgcctcacggccgccggggggcatccgcccccgggcccgcgcccgccgaagacacacaaacgaactcttgtctgaagattgcagtctgagtacttgactaaatcagttaaaactttcaacaacggatctcttggttccg

SEQ ID NO: 1546 - DNA, 204 bp, Unknown
  Kingdom: Fungi, Phylum: Ascomycota, Class: Eurotiomycetes, Order: Eurotiales, Family: Trichocomaceae, Genus:
ccgagtgagggccctctgggtccaacctcccacccgtgtttatttaccttgttgcttcggcgggcccgccttaactggccgccggggggcttacgcccccgggcccgcgcccgccgaagacaccctcgaactctgtctgaagattgtagtctgagtataaatataaattatttaaaactttcaacaacggatctcttggttccg

SEQ ID NO: 1547 - DNA, 224 bp, Unknown
  Kingdom: Fungi, Phylum: Ascomycota, Class: Eurotiomycetes, Order: Eurotiales, Family: Trichocomaceae, Genus:
ccgagtgagggccctctgggtccaacctcccacccgtgtctatcgtaccttgttgcttcggcgggcccgccgtttcgacggccgccggggaggccttgcgcccccgggcccgcgcccgccgaagaccccaacatgaacgctgttctgaaagtatgcagtctgagttgattatcgtaatcagttaaaactttcaacaacggatctcttggttccggcatcgatga

SEQ ID NO: 1548 - DNA, 234 bp, Unknown
  Kingdom: Fungi, Phylum: Ascomycota, Class: Eurotiomycetes, Order: Eurotiales, Family: Trichocomaceae, Genus:
aggatcattactgagtgagggccctctgggtccaacctcccacccgtgtttattgtaccttgttgcttcggcgcgcccgcctcacggccgccggggggcacccgcccccgggcccgcgcccgccgaagacaccattgaactcttgtctgaagattgcagtctgagtagattagctaaatcagttaaaactttcaacaacggatctcttggttccggcatcgatgaagaacgcag

SEQ ID NO: 1549 - DNA, 224 bp, Unknown
  Kingdom: Fungi, Phylum: Ascomycota, Class: Eurotiomycetes, Order: Eurotiales, Family: Trichocomaceae, Genus:
ccgagtgagggccctctgggtccaacctcccacccgtgtttatcgtaccttgttgcttcggcgggcccgcctcacggccgccggggggcacccgcccccgggcccgcgcccgccgaagacaccattgaactctgtctgaagattgcagtctgagcgattagctaaatcagttaaaactttcaacaacggatctcttggttccggcatcgatgaagaacgcagcg

SEQ ID NO: 1550 - DNA, 211 bp, Unknown
  Kingdom: Fungi, Phylum: Ascomycota, Class: Eurotiomycetes, Order: Eurotiales, Family: Trichocomaceae, Genus:
  misc_feature (153)..(153): n is a, c, g, or t
ccgagtgtagggttcctagcgagcccaacctcccacccgtgtttactgtaccttagttgcttcggcgggcccgccattcatggccgccgggggctctcagccccgggcccgcgcccgccggagacaccacgaactctgtctgatctagtgaantctgagttgattgtatcgcaatcagttaaaactttcaacaatggatctcttggttcag

SEQ ID NO: 1551 - DNA, 216 bp, Unknown
  Kingdom: Fungi, Phylum: Ascomycota, Class: Eurotiomycetes, Order: Eurotiales, Family: Trichocomaceae, Genus:
aaggatcattaccgagtgagggccctttgggtccaacctcccacccgtgtttattttaccttgttgcttcggcgggcccgcctttactggccgccggggggctcacgcccccgggcccgcgcccgccgaagacacccccgaactctgtctgaagattgaagtctgagtgaaaatataaattatttaaaactttcaacaacggatctcttggttccg

SEQ ID NO: 1552 - DNA, 202 bp, Unknown
  Kingdom: Fungi, Phylum: Ascomycota, Class: Eurotiomycetes, Order: Eurotiales, Family: Trichocomaceae, Genus:
ctgagtgagggccctctgggtccaacctcccacccgtgtttattgtaccttgttgcttcggtgcgcccgcctcacggccgccggggggcttctgcccccgggtccgcgcgcaccggagacaccattgaactctgtctgaagattgcagtctgagcataaactaaataagttaaaactttcaacaacggatctcttggttccg

SEQ ID NO: 1553 - DNA, 234 bp, Unknown
  Kingdom: Fungi, Phylum: Ascomycota, Class: Eurotiomycetes, Order: Eurotiales, Family: Trichocomaceae, Genus:
aggatcattaccgagtgagggccctctgggtccaacctcccacccgtgtttatcgtaccttgttgcttcggcgggcccgcctcacggccgccggggggcacccgcccccgggcccgcgcccgccgaagacaccattgaacgctgtctgaagattgcagtctgagcatcttagctaaatcagttaaaactttcaacaacggatctcttggttccggcatcgatgaagaacgcagc

SEQ ID NO: 1554 - DNA, 224 bp, Unknown
  Kingdom: Fungi, Phylum: Ascomycota, Class: Eurotiomycetes, Order: Eurotiales, Family: Trichocomaceae, Genus:
ccgagtgcgggccctcgcggcccaacctcccacccttgtctctatacacctgttgctttggcgggcccaccggggccacctggtcgccgggggacgttcgtccccgggcccgcgcccgccgaagcgccctgtgaaccctgatgaagatgggctgtctgagtacgatgaaaattgtcaaaactttcaacaatggatctcttggttccggcatcgatgaagaacgc

SEQ ID NO: 1555 - DNA, 215 bp, Unknown
  Kingdom: Fungi, Phylum: Ascomycota, Class: Eurotiomycetes, Order: Eurotiales, Family: Trichocomaceae, Genus:
ccgagtgcgggtcctttgggcccaacctcccatccgtgtctattgtaccctgttgcttcggcgggcccgccgcttgtcggccgccgggggggcgcctctgccccccgggcccgtgcccgccggagaccccaacacgaacactgtctgaaagcgtgcagtctgagttgattgaatgcaatcagttaaaactttcaacaatggatctcttggttccg

SEQ ID NO: 1556 - DNA, 207 bp, Unknown
  Kingdom: Fungi, Phylum: Ascomycota, Class: Eurotiomycetes, Order: Eurotiales, Family: Trichocomaceae, Genus:
ccgagtgcgggccctcgcggcccaacctcccacccttgtctcctatacacctgttgctttggcgggcccaccggggccacctggtcgccgggggacgcacgtccccgggcccgcgcccgccgaagcgcgctgtgaaccctgatgaagatgggctgtctgagactatgaaaattgtcaaaactttcaacaatggatctcttggttccg

SEQ ID NO: 1557 - DNA, 224 bp, Unknown
  Kingdom: Fungi, Phylum: Ascomycota, Class: Eurotiomycetes, Order: Eurotiales, Family: Trichocomaceae, Genus:
ccgagtgagggccctctgggtccaacctcccacccgtgtttatcgtaccttgttgcttcggcgggcccgcctcacggccgccggggggcttctgccctctggcccgcgcccgccgaagacaccattgaacgctgtctgaagattgcagtctgagcaattagctaaataagttaaaactttcaacaacggatctcttggttccggcatcgatgaagaacgcagcg

SEQ ID NO: 1558 - DNA, 198 bp, Unknown
  Kingdom: Fungi, Phylum: Ascomycota, Class: Eurotiomycetes, Order: Eurotiales, Family: Trichocomaceae, Genus:
ggaaggatcattaccgagtgcaggtctgcccccgggcaggcctaacctcccacccgtgaatacctgaccaacgttgcttcggcggtgcgcccccccgggggtagccgccggagaccacaccgaacctcctgtctttagtgttgtctgagcttgatagcaaacctattaaaactttcaacaatggatctcttggttccg

SEQ ID NO: 1559 - DNA, 213 bp, Unknown
  Kingdom: Fungi, Phylum: Ascomycota, Class: Eurotiomycetes, Order: Eurotiales, Family: Trichocomaceae, Genus:
aaggatcattaccgagtgagggccctctgggtccaacctcccacccgtgtttatcgtaccttgttgcttcggcgggcccgccgtcaggccgccgggggcttcgtgccccgggcccgtgcccgccgaagacaccattgaacgctgtctgaagattgcagtctgagcgattagctaaattagttaaaactttcaacaacggatctcttggttccg

SEQ ID NO: 1560 - DNA, 234 bp, Unknown
  Kingdom: Fungi, Phylum: Ascomycota, Class: Eurotiomycetes, Order: Eurotiales, Family:  , Genus:
gtaggtgaacctgcggaaggatcattaccgagtgcgggccctcgtggcccaacctcccacccttgtctctctacacctgttgctttggcgggcccactggggctccctggtcgccgggggacgcctgtccccgggcccgcgcccgccgaagcgcttcgtgaaccctgatgaagaagggctgtctgagtactatgaaaattgtcaaaactttcaacaatggatctcttggttccg

SEQ ID NO: 1561 - DNA, 253 bp, Unknown
  Kingdom: Fungi, Phylum: Ascomycota, Class: Leotiomycetes, Order: Erysiphales, Family: Erysiphaceae, Genus:
cagagtgcgaggctcagtcgtggcgtctgctgcgtgctgggccgaccctcccacccgtgtcgatttgtatcttgttgctttggcgggccgggccgcgtcgtcgctgcccgcatgggacatgcgtcggccgcccaccggtttcacgactggagcgcgtccgccaaagacccaaccaaaaactcatgttgtctgtgtcgtctcagctttattatgaaaattgataaaactttcaacaacggatctcttggctctg

SEQ ID NO: 1562 - DNA, 187 bp, Unknown
  Kingdom: Fungi, Phylum: Ascomycota, Class: Leotiomycetes, Order: Helotiales, Family: Sclerotiniaceae, Genus:
aaggatcattacagagttcatgcccgaaagggtagacctcccacccttgtgtattattactttgttgctttggcgagctgccttcgggccttgtatgctcgccagagaaaaccaaaactctttttattaatgtcgtctgagtactatataatagttaaaactttcaacaacggatctcttggttctg

SEQ ID NO: 1563 - DNA, 202 bp, Unknown
  Kingdom: Fungi, Phylum: Ascomycota, Class: Leotiomycetes, Order: Helotiales, Family:  , Genus:
ccgaagtataggcccttttatagggctaaacttccaccctttgtttactattcttcgttgctttggcgagacgtcttcggaccaccggctctcgggctggtgagcgctcgccagaggaaaaacaaacccaaacctttttttagtgttgtctgagaaacaagtttaattattaaaactttcaacaacggatctcttggctctg

SEQ ID NO: 1564 - DNA, 243 bp, Unknown
  Kingdom: Fungi, Phylum: Ascomycota, Class: Orbiliomycetes, Order: Orbiliales, Family: Orbiliaceae, Genus:
ccaatttgagctcggacggtccacgacctccgagccgaccaggagccctgccccgccctgcgggaaagggaacactgggttaaccctttgtgaaccaaaaaaacctttcgcttcggcagctgggcctgaccgcccataagcctgccgctggcacccaaaacaaacctgatgtcataacttatgtctgataaccaaattttcgaatgaaaatcaaaactttcaacaacggatctcttggttccc

SEQ ID NO: 1565 - DNA, 206 bp, Unknown
  Kingdom: Fungi, Phylum: Ascomycota, Class: Saccharomycetes, Order: Saccharomycetales, Family: Debaryomycetaceae, Genus:
gatcattacagtattcttttgccagcgcttaactgcgcggcgaaaaaccttacacacagtgtctttttgatacagaactcttgctttggtttggcctagagataggttgggccagaggtttaacaaaacacaatttaattatttttacagttagtcaaattttgaattaatcttcaaaactttcaacaacggatctcttggttctc

SEQ ID NO: 1566 - DNA, 210 bp, Unknown
  Kingdom: Fungi, Phylum: Ascomycota, Class: Saccharomycetes, Order: Saccharomycetales, Family: Incertae sedis, Genus:
cagtattcttttgccagcgcttaactgcgcggcgaaaaaccttacacacagtgatttctttctttgaaaacattgctttggtctggcgcaagttgggccaaaggtttattaaacttcaattttatattgaactgttattttaactaaagtcaatttgttgattaaattcaaaaatcttcaaaactttcaacaacggatctcttggttctc

SEQ ID NO: 1567 - DNA, 179 bp, Unknown
  Kingdom: Fungi, Phylum: Ascomycota, Class: Saccharomycetes, Order: Saccharomycetales, Family: Incertae sedis, Genus:
cagaatgaaaagtgcttaactgcattttttcttacacatgtgtttttctttttttgaaaactttgctttggtaggccttctatatggggcctgccagagattaaactcaaccaaattttatttaatgtcaaccgattatttaatagtcaaaactttcaacaacggatctcttggttctc

SEQ ID NO: 1568 - DNA, 222 bp, Unknown
  Kingdom: Fungi, Phylum: Ascomycota, Class: Saccharomycetes, Order: Saccharomycetales, Family: Incertae sedis, Genus:
cagtattcttttgccagcgcttaattgcgcggcgaaaaaccttacacactatgtttttttaatttgaaactattgctttggtctggcttagaaataggttgggccaaaggttttatcaaaacttcaatatttattattgaattgttatttttaattttatgtcaatttgttgattaatatcaaaaatcttcaaaactttcaacaacggatctcttggttctc

SEQ ID NO: 1569 - DNA, 229 bp, Unknown
  Kingdom: Fungi, Phylum: Ascomycota, Class: Sordariomycetes, Order: Coniochaetales, Family: Coniochaetaceae, Genus:
cattacaagaagccgaaaggctacttaaaaccatcgcgaactcatccaagttgcttcggcggcgcggctcccctcacgggggaccgcagcccccgcctctcaggaggtaaggggcagccgccggaggtacgaaactctgtattatagtggtatctctgagtataaaacaaataagttaaaactttcaacaacggatctcttggttctggcatcgatgaagaacgcagcg

SEQ ID NO: 1570 - DNA, 206 bp, Unknown
  Kingdom: Fungi, Phylum: Ascomycota, Class: Sordariomycetes, Order: Diaporthales, Family: Incertae sedis, Genus:
ctggaacgcgccccaggcgcacccagaaaccctttgtgaacttatacctgactgttgcctcggcacaggccggccccccatggggggcccctcggagacgaggagcaggcccgccggcggccaagttaactcttgtttttataccgaaactctgagcagaaaacacaaatgaatcaaaactttcaacaacggatctcttggttctg

SEQ ID NO: 1571 - DNA, 245 bp, Unknown
  Kingdom: Fungi, Phylum: Ascomycota, Class: Sordariomycetes, Order: Hypocreales, Family: Cordycipitaceae, Genus:
gaacctgcggagggatcattatcgagtttatcaactcccaaccctatgtgaacctacctttatgttgcttcggcggtgtcgcgccgggttgcccccagcgggctcccgggaccacgcgcccgccggagaccacaaactcttgattttgcgaaagcagtattcttctgagtggccgaaaggcaaaaaacaaatgaatcaaaactttcaacaacggatctcttggttctggcatcgatgaagaacgc

SEQ ID NO: 1572 - DNA, 229 bp, Unknown
  Kingdom: Fungi, Phylum: Ascomycota, Class: Sordariomycetes, Order: Hypocreales, Family: Cordycipitaceae, Genus:
attacagagtttacaactcccaaacccttatgtgaacatacctatatgttgcttcggcggactcgccccggcgtccggacggcctagcgccgcccgcggcccggactcaggcggccgccggagacctaccaaactcttttgtatcatgagtatcttctgaatccgccgcaaggcaaaacaaatgaatcaaaactttcaacaacggatctcttggttctggcatcgatga

SEQ ID NO: 1573 - DNA, 231 bp, Unknown
  Kingdom: Fungi, Phylum: Ascomycota, Class: Sordariomycetes, Order: Hypocreales, Family: Hypocreaceae, Genus:
ccgagtttacaactcccaaacccaatgtgaacgttaccaaactgttgcctcggcgggatctctgccccgggtgcgtcgcagccccggaccaaggcgcccgccggaggaccaacctaaaactcttattgtataccccctcgcgggtttttttataatctgagccttctcggcgcctctcgtaggcgtttcgaaaatgaatcaaaactttcaacaacggatctcttggttctg

SEQ ID NO: 1574 - DNA, 245 bp, Unknown
  Kingdom: Fungi, Phylum: Ascomycota, Class: Sordariomycetes, Order: Hypocreales, Family: Hypocreaceae, Genus:
agcggagggatcattaccgagtttacaactcccaaacccaatgtgaacgttaccaaactgttgcctcggcgggatctctgccccgggtgcgtcgcagccccggaccaaggcgcccgccggaggaccaaccaaaactcttattgtataccccctcgcgggttttttataatctgagccttctcggcgcccctcgtgggcgtttcgaaaatgaatcaaaactttcaacaacggatctcttggttctg

SEQ ID NO: 1575 - DNA, 225 bp, Unknown
  Kingdom: Fungi, Phylum: Ascomycota, Class: Sordariomycetes, Order: Hypocreales, Family: Hypocreaceae, Genus:
tttacaactcccaaacccaatgtgaacgttaccaaactgttgcctcggcgggatctctgccccgggtgcgtcgcagccccggaccaaggcgcccgccggaggaccaaccaaaactcttattgtataccccctcgcgggtttttttataatctgagccttctcggcgcctctcgtaggcgtttcgaaaatgaatcaaaactttcaacaacggatctcttggttctg

SEQ ID NO: 1576 - DNA, 224 bp, Unknown
  Kingdom: Fungi, Phylum: Ascomycota, Class: Sordariomycetes, Order: Hypocreales, Family: Hypocreaceae, Genus:
ccgagtttacaactcccaaacccaatgtgaacgttaccaaactgttgcctcggcggggtcacgccccgggtgcgtcgcagccccggaaccaggcgcccgccggaggaaccaaccaaactctttctgtagtcccctcgcggacgtatttcttacagctctgagcaaaaattcaaaatgaatcaaaactttcaacaacggatctcttggttctggcatcgatgaag

SEQ ID NO: 1577 - DNA, 214 bp, Unknown
  Kingdom: Fungi, Phylum: Ascomycota, Class: Sordariomycetes, Order: Hypocreales, Family: Hypocreaceae, Genus:
ccgagtttacaactcccaaacccaatgtgaaccataccaaactgttgcctcggcggggtcacgccccgggtgcgtcgcagccccggaaccaggcgcccgccggagggaccaaccaaactcttttctgtagtcccctcgcggacgttatttcttacagctctgagcaaaaattcaaaatgaatcaaaactttcaacaacggatctcttggttctg

SEQ ID NO: 1578 - DNA, 226 bp, Unknown
  Kingdom: Fungi, Phylum: Ascomycota, Class: Sordariomycetes, Order: Hypocreales, Family: Hypocreales incertae sedis, Genus: Acremonium
gttggtgaaccagcggagggatcattactgagtgtaaaaactcccaaaccactgtgaacataccactgttgcttcggcggcctcgtcccgcggcgctcccccctagcggggcgtgacccggacccaggcgaccgccggaggcaccaaactcttgtctttatagtgactttctgagtggcataagcaaaataaatcaaaactttcagcaacggatctcttggttctg

SEQ ID NO: 1579 - DNA, 219 bp, Unknown
  Kingdom: Fungi, Phylum: Ascomycota, Class: Sordariomycetes, Order: Hypocreales, Family: Hypocreales incertae sedis, Genus: Emericellopsis
gttggtgaaccagcggagggatcattactgagtttacaactcccaaacccctgtgaacatacctatgttgcttcggcgggccgtcccgcggcgcgcccacgtggcgtgacccggaaccaggcgcccgccggggacccaaactcttgcctttgtagtgtctcctctgagtggcataagcaaaaataaacaaaactttcagcaacggatctcttggttctg

SEQ ID NO: 1580 - DNA, 195 bp, Unknown
  Kingdom: Fungi, Phylum: Ascomycota, Class: Sordariomycetes, Order: Hypocreales, Family: Incertae sedis, Genus: Acremonium
tctgagtgtaaaactccctaaaccctgtgcaaacctaccaaagttgcttcggcggcctaaatcgccccgggcgccccagcgcgccccggacccaggcgaccgccggaggccccaaactcctgaatttacagtggatttttctgagtggcataagcaaataaatcaaaactttcagcaacggatctcttggttctg

SEQ ID NO: 1581 - DNA, 198 bp, Unknown
  Kingdom: Fungi, Phylum: Ascomycota, Class: Sordariomycetes, Order: Hypocreales, Family: Incertae sedis, Genus:
cattaccagagtgccctaggctctccaacccattgtgaacatacctaacgttccctcggcgggctcagcgcgcggtgcctccgggctccgggcgtccgccggggacaaccaaaccctgattttatcgtgtatctctgaggggcgaaagcccgaaaacaaaataaatcaaaactttcaacaacggatctcttggctctg

SEQ ID NO: 1582 - DNA, 195 bp, Unknown
  Kingdom: Fungi, Phylum: Ascomycota, Class: Sordariomycetes, Order: Hypocreales, Family: Incertae sedis, Genus:
ccagagtgccctaggctctccaacccattgtgaacttaccaaacgttccctcggcgggctcagcgcgcggtggcctccgggcctccgggcgtccgccggggaaaaccaaaccctgatttaatcgtatttctctgaggggcgaaagcccgaaaacaaaatgaatcaaaactttcaacaacggatctcttggctctg

SEQ ID NO: 1583 - DNA, 191 bp, Unknown
  Kingdom: Fungi, Phylum: Ascomycota, Class: Sordariomycetes, Order: Hypocreales, Family: Incertae sedis, Genus:
cattaccgagtgtaaaaactcccaaaccattgtgaacctaccactgttgcttcggcggcctcgccccgggcgcgttcgcgcggcccggacccaggcgtccgccggaggctccaaactcttgtcttttagtgtatttctgagtggcataagcaaataaatcaaaactttcagcaacggatctcttggttctg

SEQ ID NO: 1584 - DNA, 194 bp, Unknown
  Kingdom: Fungi, Phylum: Ascomycota, Class: Sordariomycetes, Order: Hypocreales, Family: Incertae sedis, Genus:
ccagagagccttttggcactccaacccattgtgaacatacctacgtttccctcggcgggctcagcgcgaggcggtcttccgccctcgcgtccgccgggggcacccaaactcgaatttatatcgtgtatctctgagaggcgaaagcccgtaaaacaaatgaatcaaaactttcaacaacggatctcttggctctg

SEQ ID NO: 1585 - DNA, 180 bp, Unknown
  Kingdom: Fungi, Phylum: Ascomycota, Class: Sordariomycetes, Order: Hypocreales, Family: Nectriaceae, Genus:
ccgagtttacaactcccaaacccctgtgaacataccttaatgttgcctcggcggatcagcccgcgccccgtaaaacgggacggcccgccagaggacccaaactctaatgtttcttattgtaacttctgagtaaaacaaacaaataaatcaaaactttcaacaacggatctcttggttctg

SEQ ID NO: 1586 - DNA, 182 bp, Unknown
  Kingdom: Fungi, Phylum: Ascomycota, Class: Sordariomycetes, Order: Hypocreales, Family: Nectriaceae, Genus:
cattaccgagtttacaactcccaaacccctgtgaacataccttatgttgcctcggcggatcagcccgcgccccgtaaaaagggacggcccgccgcaggaaccctaaactctgtttttagtggaacttctgagtataaaaaacaaataaatcaaaactttcaacaacggatctcttggttctg

SEQ ID NO: 1587 - DNA, 177 bp, Unknown
  Kingdom: Fungi, Phylum: Ascomycota, Class: Sordariomycetes, Order: Hypocreales, Family: Nectriaceae, Genus:
ccgagtttacaactcccaaacccctgtgaacataccaattgttgcctcggcggatcagcccgctcccggtaaaacgggacggcccgccagaggacccctaaactctgtttctatatgtaacttctgagtaaaaccataaataaatcaaaactttcaacaacggatctcttggttctg

SEQ ID NO: 1588 - DNA, 166 bp, Unknown
  Kingdom: Fungi, Phylum: Ascomycota, Class: Sordariomycetes, Order: Hypocreales, Family: Nectriaceae, Genus:
tcccaaacccctgtgaacatacctttatgttgcctcggcggatcagcccgcgccccgtaaaacgggacggcccgccgcaggaaaccctaaactctgtttttagtggaacttctgagtataaaaaacaaataaatcaaaactttcaacaacggatctcttggttctg

SEQ ID NO: 1589 - DNA, 178 bp, Unknown
  Kingdom: Fungi, Phylum: Ascomycota, Class: Sordariomycetes, Order: Hypocreales, Family: Nectriaceae, Genus:
accgagtttacaactcccaaacccctgtgaacataccttatgttgcctcggcggatcagcccgcgccccgtaaaaagggacggcccgccgcaggaaccctaaactctgtttttagtggaacttctgagtataaaaaacaaataaatcaaaactttcaacaacggatctcttggttctg

SEQ ID NO: 1590 - DNA, 207 bp, Unknown
  Kingdom: Fungi, Phylum: Ascomycota, Class: Sordariomycetes, Order: Hypocreales, Family: Nectriaceae, Genus:
gttggtgaaccagcggagggatcattaccgagttattcaactcatcaaccctgtgaacttacctaaacgttgcttcggcgggaatagacggccctgtaaaacgggccgcccccgccagaggactcttaactctgtttcttataatgtttcttctgagtaaaacaagcaaataaattaaaactttcaacaacggatctcttggctctg

SEQ ID NO: 1591 - DNA, 177 bp, Unknown
  Kingdom: Fungi, Phylum: Ascomycota, Class: Sordariomycetes, Order: Hypocreales, Family: Nectriaceae, Genus:
ccgagtttacaactcccaaacccctgtgaacatacctatacgttgcctcggcggatcagcccgcgccccgtaaaacgggacggcccgcccgaggaccctaaactctgtttttagtggaacttctgagtaaaacaaacaaataaatcaaaactttcaacaacggatctcttggttctg

SEQ ID NO: 1592 - DNA, 165 bp, Unknown
  Kingdom: Fungi, Phylum: Ascomycota, Class: Sordariomycetes, Order: Hypocreales, Family: Nectriaceae, Genus:
ctcccaaacccctgtgaacataccaattgttgcctcggcggatcagcccgctcccggtaaaacgggacggcccgccagaggacccctaaactctgtttctatatgtaacttctgagtaaaaccataaataaatcaaaactttcaacaacggatctcttggttctg

SEQ ID NO: 1593 - DNA, 177 bp, Unknown
  Kingdom: Fungi, Phylum: Ascomycota, Class: Sordariomycetes, Order: Hypocreales, Family: Nectriaceae, Genus:
ccgagtttacaactcccaaacccctgtgaacataccaattgttgcctcggcggatcagcccgctcccggtaaaacgggacggcccgccagaggacccccaaactctgtttctatatgtaacttctgagtaaaaccataaataaatcaaaactttcaacaacggatctcttggttctg

SEQ ID NO: 1594 - DNA, 167 bp, Unknown
  Kingdom: Fungi, Phylum: Ascomycota, Class: Sordariomycetes, Order: Hypocreales, Family: Nectriaceae, Genus:
tcccaaacccctgtgaacataccttaatgttgcctcggcggatcagcccgcgccccgtaaaacgggacggcccgccagaggacccaaactctaatgtttcttattgtaacttctgagtaaaacaaacaaataaatcaaaactttcaacaacggatctcttggttctg

SEQ ID NO: 1595 - DNA, 178 bp, Unknown
  Kingdom: Fungi, Phylum: Ascomycota, Class: Sordariomycetes, Order: Hypocreales, Family: Nectriaceae, Genus:
ccgagtttacaactcccaaacccctgtgaacataccacttgttgcctcggcggatcagcccgctcccggtaaaacgggacggcccgccagaggacccctaaaactctgtttctatatgtaacttctgagtaaaaccataaataaatcaaaactttcaacaacggatctcttggttctg

SEQ ID NO: 1596 - DNA, 166 bp, Unknown
  Kingdom: Fungi, Phylum: Ascomycota, Class: Sordariomycetes, Order: Hypocreales, Family: Nectriaceae, Genus:
actcccaaacccctgtgaacataccaattgttgcctcggcggatcagcccgctcccggtaaaacgggacggcccgccagaggacccctaaactctgtttctatatgtaacttctgagtaaaaccataaataaatcaaaactttcaacaacggatctcttggttctg

SEQ ID NO: 1597 - DNA, 206 bp, Unknown
  Kingdom: Fungi, Phylum: Ascomycota, Class: Sordariomycetes, Order: Hypocreales, Family: Nectriaceae, Genus:
gttggtgaaccagcggagggatcattaccgagttatacaactcatcaaccctgtgaacatacctaaaacgttgcttcggcgggaacagacggccctgtaacaacgggccgcccccgccagaggacccctaactctgtttttataatgtttttctgagtaaacaagcaaataaattaaaactttcaacaacggatctcttggctctg

SEQ ID NO: 1598 - DNA, 186 bp, Unknown
  Kingdom: Fungi, Phylum: Ascomycota, Class: Sordariomycetes, Order: Hypocreales, Family:  , Genus:
ccgagtttacaactcccaaacccatgtgaacatacctatcgttgcttcggcggatcgccccgggcgccttgcgtgccccggatccaggcggccgccgggggaccttaactcttgtttttactgagaatcttctgagtcgtttttacaaataaataaaaactttcaacaacggatctcttggttctg

SEQ ID NO: 1599 - DNA, 193 bp, Unknown
  Kingdom: Fungi, Phylum: Ascomycota, Class: Sordariomycetes, Order: Hypocreales, Family:  , Genus:
ctgagtctaacaaactcccaaacccctgtgaacatacctactgttgcttcggcgggaccgccccgggcgccttcgcggtgccccggaaccaggcgcccgccggggacatcaaactcttgattgttatagtggcattctctgagtaaaacatacaaataagtcaaaactttcaacaacggatctcttggctctg

SEQ ID NO: 1600 - DNA, 215 bp, Unknown
  Kingdom: Fungi, Phylum: Ascomycota, Class: Sordariomycetes, Order: Incertae sedis, Family: Glomerellaceae, Genus:
agggatcattactgagttaccgctctataaccctttgtgaacatacctaactgttgcttcggcgggcagggggtcccctcggggacgccctcccggccacgcccttcacggggcgaggcgcccgccggaggataccaaactctattttaacgacgtttcttctgagtggcacaagcaaataattaaaacttttaacaacggatctcttggttctg

SEQ ID NO: 1601 - DNA, 190 bp, Unknown
  Kingdom: Fungi, Phylum: Ascomycota, Class: Sordariomycetes, Order:  , Family:  , Genus:
atcattacagagttatccaactcccaaacccatgtgaacttatctctttgttgcctcggcgcaagctacccgggacccagcgccccgggcggcccgccggcggacaaaccaaactcttgttatcttagttgattatctgagcgtcttatttaataagtcaaaactttcaacaacggatctcttggttctg

SEQ ID NO: 1602 - DNA, 193 bp, Unknown
  Kingdom: Fungi, Phylum: Ascomycota, Class: Sordariomycetes, Order:  , Family:  , Genus:
attaccgagtttacaactcccaaacccctgtgaaccatacctgtcgttgcttcggcggccacgccccggcgccctcgtgcccggaaccaggcgcccgccggaggccccaaaaaaccatgtttaccacagtggcattatctgagtggcacaagcaaataaatcaaaactttcaacaacggatctcttggttctg

SEQ ID NO: 1603 - DNA, 218 bp, Unknown
  Kingdom: Fungi, Phylum: Ascomycota, Class:  , Order:  , Family: , Genus:
cctgcggagggatcattacacaaatatgaaggcgggctggcacctcccggggtggccagccttgctgaattattccacccgtgtcttttgcgtacttcttgtttccttggtgggctcgcccaccacaaggaccaacccataaacctttttgcaatggcaatcagcgtcagtaacaatgtaataatttacaactttcaacaacggatctcttggttctg

SEQ ID NO: 1604 - DNA, 210 bp, Unknown
  Kingdom: Fungi, Phylum: Ascomycota, Class:  , Order:  , Family: , Genus:
cagagttatacaactcccataccatctgttaacctacccagttatgcctcggcgtaagctcggttggaggcacctgcagctaccctgtagttgcggactgccaactccagccgcggcccgccggcggtacactaaactctgttttattttatattctgagcgtcttattttaataagttaaaactttcaacaacggatctcttggttctg

SEQ ID NO: 1605 - DNA, 177 bp, Unknown
  Kingdom: Fungi, Phylum: Ascomycota, Class:  , Order:  , Family: , Genus:
ccgagtttacaactcccaaacccctgtgaacataccacttgttgcctcggcggatcagcccgctcccggtaaaacgggacggcccgccagaggacccctaaactctgtttctatatgtaacttctgagtaaaaccataaataaatcaaaactttcaacaacggatctcttggttctg

SEQ ID NO: 1606 - DNA, 230 bp, Unknown
  Kingdom: Fungi, Phylum: Ascomycota, Class:  , Order:  , Family: , Genus:
tcattgctggaacaaacgccctcacgggtgctacccagaaaccctttgtgaatactacctaaaatgttgcctcggcattggttggcctctttgaggtccctttccctcggggaaggagcagaccggccggtggccctataaactcttgtttttgtaatatcatctgagtaaaaaacataaataaatcaaaactttcaacaacggatctcttggttctggcatcgatgaag

SEQ ID NO: 1607 - DNA, 234 bp, Unknown
  Kingdom: Fungi, Phylum: Ascomycota, Class:  , Order:  , Family: , Genus:
cacaatatgaaggcgggctggacaaacccccctagctgggcactgcttcacggcggtgcgcggtttgggtggccggccctgctgaactattcacccgtgtcttttgcgtacctcttgtttcctgggcgggctcgcccgccaccaggaccaaccataaacctttttgtaatagcaatccgcgtcagtaaacaatgtaatcaattacaactttcaacaacggatctcttggttctg

SEQ ID NO: 1608 - DNA, 179 bp, Unknown
  Kingdom: Fungi, Phylum: Ascomycota, Class:  , Order:  , Family: , Genus:
ccgagtttacaactcccaaacccctgtgaacatacctatacgttgcctcggcggatcagcccgcgccccgtaaaacgggacggcccgccgcaggacccataaaccctgaattttattgtaacttctgagtttaaaaaacaaataaatcaaaactttcaacaacggatctcttggttctg

SEQ ID NO: 1609 - DNA, 204 bp, Unknown
  Kingdom: Fungi, Phylum: Ascomycota, Class:  , Order:  , Family: , Genus:
cagagttgcaaaactccctaaaccattgtgaacgttacctataccgttgcttcggcgggcggccccggggtttaccccccgggcgcccctgggccccaccgcgggcgcccgccggaggtcaccaaactcttgataatttatggcctctctgagtcttctgtactgaataagtcaaaactttcaacaacggatctcttggttctg

SEQ ID NO: 1610 - DNA, 211 bp, Unknown
  Kingdom: Fungi, Phylum: Ascomycota, Class:  , Order:  , Family: , Genus:
ccgagtttacaactcccaaacccatgtgaacatacctttacgttgcttcggcggagccgccccggcgcccggaacctcttcggtttcgcggcccggaaccaggcgcccgccggaggccacaaactcttttgtttttacagtttcttctgagtgtgccgcaaggcaaaatacaaatgaatcaaaactttcaacaacggatctcttggttctg

SEQ ID NO: 1611 - DNA, 203 bp, Unknown
  Kingdom: Fungi, Phylum: Ascomycota, Class:  , Order:  , Family: , Genus:
tagagttaacaaaacaactcccaaccctttgtgaaccttacctaccgttgcttcggcggaccgccccgggcgctgcgtgccccggacccaaggcgcccgccggggaccacacgaaccctgtttaacaaacatgtgtatcctctgagcgagccgaaaggcaacaaaacaaatcaaaactttcaacaacggatctcttggttctg

SEQ ID NO: 1612 - DNA, 194 bp, Unknown
  Kingdom: Fungi, Phylum: Ascomycota, Class:  , Order:  , Family: , Genus:
ccagagtgccttttggctctccaacccactgtgaacatacctacgtttccctcggcgggctcagcgcgttgcggttccgccgcctcgcgtccgccgggggcacccaaactcgaatttatatcgtgtatctctgaggggcgaaagcccgtaaaacaaatgaatcaaaactttcaacaacggatctcttggctctg

SEQ ID NO: 1613 - DNA, 227 bp, Unknown
  Kingdom: Fungi, Phylum: Ascomycota, Class:  , Order:  , Family: , Genus:
tccatctcaaccaggtgcggtcgcggccctcgggggttctctcccgggtggtaggggtaacaccctcacgcgccgcattcctgcatcctttttttacgagcacctttcgttctccttcggcggggcaacctgccgctggaacttaacaaaaccttttttgcatctagcattacctgttctgatacaaacaatcgttacaactttcaacaatggatctcttggctctg

SEQ ID NO: 1614 - DNA, 211 bp, Unknown
  Kingdom: Fungi, Phylum: Basidiomycota, Class: Agaricomycetes, Order: Cantharellales, Family: Ceratobasidiaceae, Genus:
ttgaatgaatgtagagttggttgtcgctggccctttcgggggtatgtgcacgccttctctttcatccacacacacctgtgcacttgtgagacggagggctttaattagtcttccgtctattcaaccacacaaactcattgtatttaaactgaatgtaattgatgtaacgcatcattagaactaagtttcaacaacggatctcttggctctc

SEQ ID NO: 1615 - DNA, 201 bp, Unknown
  Kingdom: Fungi, Phylum: Basidiomycota, Class: Agaricomycetes, Order: Cantharellales, Family: Hydnaceae, Genus:
atgaattgaaagggagttgatgctggccaggtctcttggcatgtgctcgcttccgacaatcttatccatacacctgtgcacactgtgagggcacgaaagtgcccttatttactacatacacctaatttggaaatcgcacgtgacttgcgtcgtatggcgcttaaataaatacaacttttaacaacggatctcttggctctc

SEQ ID NO: 1616 - DNA, 216 bp, Unknown
  Kingdom: Fungi, Phylum: Basidiomycota, Class: Agaricomycetes, Order: Corticiales, Family: Corticiaceae, Genus:
agtgtttctagtatgtgcacgccacaccttcaatcccacttaccctgtgcaccttctgtaatagatctatgtggatacggagatgtgaaagtttgcgctctcctactctgttgaagcagtctactacgtttttttacacacacacacaatagtcattgaatgtattttttattcttatgataaaaacaactttcaacaacggatctcttggctctc

SEQ ID NO: 1617 - DNA, 281 bp, Unknown
  Kingdom: Fungi, Phylum: Basidiomycota, Class: Agaricomycetes, Order: Hymenochaetales, Family: Incertae sedis, Genus: Trichaptum
acgagttttgaagtgggcttgatgctggcttgtaacagagcactgtgctcagccccgctccaatccattcaacccctgtgcactattcggagtgttgcaagctgagacaatgtggggagtggtcccggttgtatttctaatgcgacttgggcttactttcaaacggtcaaggcttgtcctccggtttatattacaaacacttttattgtcttgtcgaatgtattagcctctcgttaggcgaaacttaaatacaactttcaacaacggatctcttggctctc

SEQ ID NO: 1618 - DNA, 224 bp, Unknown
  Kingdom: Fungi, Phylum: Basidiomycota, Class: Agaricomycetes, Order: Russulales, Family: Stereaceae, Genus:
atgaaatttatgactggagttgtagctggcccttaaaaacggcatgtgcacgctcctttcactaatccacacacacctgtgcaccttcgcgggggtcttcttttcggagaaggctcgcgtccctttacacaccctttgtatgtcttaagaatgtctactcgatgtaataaaacgcatctaatacaactttcaacaacggatctcttggctctcgcatcgatgaa

SEQ ID NO: 1619 - DNA, 215 bp, Unknown
  Kingdom: Fungi, Phylum: Basidiomycota, Class: Agaricomycetes, Order: Russulales, Family:  , Genus:
gcgaagtcaagtccggacccgttggggattgtagctggcctaacggcaagtgctcgtccctcgggtacgtgaccttcactaccacaccccactgtgaaccaagcgggaggtcgaaaggcctcttgcatcttatataaaccccaattgcatgtcttagaatgtcatagcgttaactcgcaactatacaactttcaacaacggatctcttggctctc

SEQ ID NO: 1620 - DNA, 175 bp, Unknown
  Kingdom: Fungi, Phylum: Basidiomycota, Class: Cystobasidiomycetes, Order: Erythrobasidiales, Family: Incertae sedis, Genus:
atgaatttttagggcgctctttttagaggtccgaccaatttcatttccacacactgtgaacacacttcatttttacacacaatttataaacacacaagtctataagaatgtttaaagtctcttaatcgagcataaagttataatacaactttcggcaacggatctcttggctctc

SEQ ID NO: 1621 - DNA, 189 bp, Unknown
  Kingdom: Fungi, Phylum: Basidiomycota, Class: Microbotryomycetes, Order: Sporidiobolales, Family: Incertae sedis, Genus:
gtgaatctaggacgtccaacttaacttggagtccgaactctcactttctaaccctgtgcatctgttttaaaattggctagtagctcttcggagtgaaccaccatttttcacttatacaaacacaaagtctatgaatgtaagcaaatttataacaaaacaaaactttcaacaacggatctcttggctctc

SEQ ID NO: 1622 - DNA, 189 bp, Unknown
  Kingdom: Fungi, Phylum: Basidiomycota, Class: Microbotryomycetes, Order: Sporidiobolales, Family: Incertae sedis, Genus:
aaggatcattagtgaacataggacgtccaacttaacttggagtccgaactctcactttctaaccctgtgcatttgtttggggtagtagcctttcggggcgaatccctattcacttataaacacaaagtctatgaatgtatttaattttataacaaaataaaactttcaacaacggatctcttggctctc

SEQ ID NO: 1623 - DNA, 191 bp, Unknown
  Kingdom: Fungi, Phylum: Basidiomycota, Class: Microbotryomycetes, Order: Sporidiobolales, Family: Incertae sedis, Genus:
gcggaaggatcattagtgaatactaggacgttcaatttaacttgaagtccgaactctcactttctaaccctgtgcatttgttttggttagtaggattcgtctgaacacctcttcatttacaaacacaaagtctatgaatgtataaagtttataacaaaacaaaactttcaacaacggatctcttggctctc

SEQ ID NO: 1624 - DNA, 182 bp, Unknown
  Kingdom: Fungi, Phylum: Basidiomycota, Class: Microbotryomycetes, Order: Sporidiobolales, Family: Incertae sedis, Genus:
gtgaatataggacgtccaacttaacttggagtccgaactctcactttctaaccctgtgcacttgtttgggatagtaactctcgcaagagagcgaactcctattcacttataaacacaaagtctatgaatgtattaaattttataacaaaataaaactttcaacaacggatctcttggctctc

SEQ ID NO: 1625 - DNA, 182 bp, Unknown
  Kingdom: Fungi, Phylum: Basidiomycota, Class: Microbotryomycetes, Order: Sporidiobolales, Family: Incertae sedis, Genus:
gtgaatctaggacgtccaacttaacttggagtccgaactctcactttctaaccctgtgcatctgttaaattggactagtagctcttcggagtgaaccgccattcacttataaacacaaagtctatgaatgtatacaaatttataacaaaacaaaactttcaacaacggatctcttggctctc

SEQ ID NO: 1626 - DNA, 173 bp, Unknown
  Kingdom: Fungi, Phylum: Basidiomycota, Class: Microbotryomycetes, Order: Sporidiobolales, Family: Incertae sedis, Genus:
atgaaatgcaaggacgctctttttagaggtccgacccaaatcattttcctttacactgtgcacatactacttttttacaccaatttttaacacatcagtcttaagaatgtaaatcaagtctcgaaagagcaataaataaaacaaaactttcagcaacggatctcttggctctc

SEQ ID NO: 1627 - DNA, 179 bp, Unknown
  Kingdom: Fungi, Phylum: Basidiomycota, Class: Microbotryomycetes, Order: Sporidiobolales, Family: Incertae sedis, Genus:
gtgaataacaggacgttcaatttaacttgaagtccgaactctcacatctaaccctgtgcatttgttttggttagtagagcgcttgcgttcgaacacctcttcattttacaaacactaagtcaaagtatgtttaaatttataacaaaacaaaactttcaacaacggatctcttggctctc

SEQ ID NO: 1628 - DNA, 174 bp, Unknown
  Kingdom: Fungi, Phylum: Basidiomycota, Class: Microbotryomycetes, Order: Sporidiobolales, Family: Incertae sedis, Genus:
atgaaattcaaggacgctctttttagaggtccgaccaattacattttacctttactctgtgcacacactactctttacaccattttttaactctatagttttaagaatgtaaaacaagtctcgaaagagcaacataacaaaacaaaactttcggcaacggatctcttggctctc

SEQ ID NO: 1629 - DNA, 176 bp, Unknown
  Kingdom: Fungi, Phylum: Basidiomycota, Class: Microbotryomycetes, Order: Sporidiobolales, Family: Incertae sedis, Genus:
ttgaaaacaagggtgtccaatttaacttggaacccgaacttctcaattctaactttgtgcatctgtattatggcgagcagtcttcggattgtgagccttcacttataaacactagtctatgaatgtaaaatttttataacaaataaaaactttcaacaacggatctcttggctctc

SEQ ID NO: 1630 - DNA, 181 bp, Unknown
  Kingdom: Fungi, Phylum: Basidiomycota, Class: Microbotryomycetes, Order: Sporidiobolales, Family:  , Genus:
gtgaataaatagggtgtccaatttaacttggaacccgaccttctcacatctaaccctgtgcatctgtattaatggcgagcaattttcggattgtgagccatttcactttataaacactagtctatgaatgtaaaatttttataacaaataaaaactttcaacaacggatctcttggctctc

SEQ ID NO: 1631 - DNA, 242 bp, Unknown
  Kingdom: Fungi, Phylum: Basidiomycota, Class: Tremellomycetes, Order: Cystofilobasidiales, Family: Cystofilobasidiaceae, Genus:
gtgattaaacgggaagcgtcttaactgaccttctcacccttcacatccacatacaccctgtgaactgtttggcttcaactctcgagttgggctctcctatcgatagattagcaatagtctagcgagaagagggttcgtctcgagagcgggagtcatcatttttatacatacacaaagtctaatgaatgtaaacgttttatataaacaaaataaaactttcaacaacggatctcttggttctc

SEQ ID NO: 1632 - DNA, 177 bp, Unknown
  Kingdom: Fungi, Phylum: Basidiomycota, Class: Tremellomycetes, Order: Cystofilobasidiales, Family: Cystofilobasidiaceae, Genus:
aagtaaacgccctccggggctctcttttattcacacacccctgtgcactttggccacctgccgcgcttttctgcgtttgtaggtgtgtcttttttactatacactatatacacaagtcattgaatgtaaaatcgttttaaactaatataactttcaacaacggatctcttggttctc

SEQ ID NO: 1633 - DNA, 232 bp, Unknown
  Kingdom: Fungi, Phylum: Basidiomycota, Class: Tremellomycetes, Order: Cystofilobasidiales, Family: Cystofilobasidiaceae, Genus:
gtgattaaaccggagagcgtcttcattgacctctccaacccttcacatccacatacaccctgtgaaccgtttggctttgttgagctgaaagttgaaagaataggcttgcaaaagtctagtcggacgatggacagatcgcaaggtcatcatcatatacatacacgaagtctaatgaatgtaaacgttttatataaacaaaataaaactttcaacaacggatctcttggttctc

SEQ ID NO: 1634 - DNA, 183 bp, Unknown
  Kingdom: Fungi, Phylum: Basidiomycota, Class: Tremellomycetes, Order: Filobasidiales, Family: Filobasidiaceae, Genus:
ttgaattcaaatcatctgtggcttcggtccggatgtgccaacaggtaacactgttggtaattctatccataacacctgtgaactgttggatgcttgcatccacttttatactaaacattattgtaacaaatgtagtcttattataacataataaaacttttaacaacggatctcttggctctc

SEQ ID NO: 1635 - DNA, 191 bp, Unknown
  Kingdom: Fungi, Phylum: Basidiomycota, Class: Tremellomycetes, Order: Filobasidiales, Family: Filobasidiaceae, Genus:
atgaataaaggtatcacctcacggctgtgtgttggatcattgtgcaatagtctttgatccacttcctatcatatccataacacctgtgcactgttggatgcttgcatccacttttaaactaaacattattgtaacaaatgtagtcttattataacataataaaactttcaacaacggatctcttggctctc

SEQ ID NO: 1636 - DNA, 181 bp, Unknown
  Kingdom: Fungi, Phylum: Basidiomycota, Class: Tremellomycetes, Order: Filobasidiales, Family: Filobasidiaceae, Genus:
atgattataatcgtactgttcacgcagtatgtggggtggtgacttcggtcccgctcattcatatccataacacctgtgcactgttggatgcttgcatccacttttaaactaaacattattgtaacaaatgtagtcttattataacataataaaactttcaacaacggatctcttggctctc

SEQ ID NO: 1637 - DNA, 184 bp, Unknown
  Kingdom: Fungi, Phylum: Basidiomycota, Class: Tremellomycetes, Order: Filobasidiales, Family: Filobasidiaceae, Genus:
atgattaactgtctgtcgagcttgctcacagacttatcatatccataacacctgtgcacttgtcgggtggcttagtgaagaccgcaaggttgggactatccatctactttacataacaatttagtaacaaatgtagtcttattataacataataaaactttcaacaacgggtctcttggctctc

SEQ ID NO: 1638 - DNA, 195 bp, Unknown
  Kingdom: Fungi, Phylum: Basidiomycota, Class: Tremellomycetes, Order: Filobasidiales, Family: Filobasidiaceae, Genus:
atgaatacagatgcctgtcgagcttgctcacgggctttctatcatatccataacacctgtgcacttgttggatgttctagagacgtagggttaaacctgaagtcaatagtcatccacttacactaaacaataatgtaacaaatgtagtcttattataacaaaataaaactttcaacaacggatctcttggctctc

SEQ ID NO: 1639 - DNA, 184 bp, Unknown
  Kingdom: Fungi, Phylum: Basidiomycota, Class: Tremellomycetes, Order: Filobasidiales, Family: Filobasidiaceae, Genus:
atgattgaacgtctgtcgagcttgctcacaggcacatcatatccataacacctgtgcacttgtcggatggcttagtgaagaccgcaaggttggatctatccatctactttacataacaattctgtaacaaatgtagtcttattataacataataaaactttcaacaacggatctcttggctctc

SEQ ID NO: 1640 - DNA, 184 bp, Unknown
  Kingdom: Fungi, Phylum: Basidiomycota, Class: Tremellomycetes, Order: Filobasidiales, Family: Filobasidiaceae, Genus:
atgattgaccgtctgtcgagcttgctcacaggcacatcatatccataacacctgtgcacttgtcggatggcttagtgaagaccgcaaggttggatctatccatctactttacataacaattctgtaacaaatgtagtcttattataacataataaaactttcaacaacggatctcttggctctc

SEQ ID NO: 1641 - DNA, 185 bp, Unknown
  Kingdom: Fungi, Phylum: Basidiomycota, Class: Tremellomycetes, Order: Tremellales, Family: Incertae sedis, Genus:
ttgaattgtttgtttgaattggcttaaaaccccaattcagcaatacatatccataacacctgtgcactgttggatgagcaaactcgcaagagcaagcaagtccacttttacaccaaacaatttgtaacaaatgtagtcttattataacaataataaaactttcaacaacggatctcttggttctc

SEQ ID NO: 1642 - DNA, 175 bp, Unknown
  Kingdom: Fungi, Phylum: Basidiomycota, Class: Tremellomycetes, Order:  , Family:  , Genus:
aagtaaacgccctccggggctctctttattcacacacccctgtgcactttggccacctgccgcgcttaactgcgttagtaggtgtgtctctttaattatacccatatacacaagtcattgaatgtaaaatcgttataaactaatataactttcaacaacggatctcttggttctc

SEQ ID NO: 1643 - DNA, 186 bp, Unknown
  Kingdom: Fungi, Phylum: Basidiomycota, Class:  , Order:  , Family:  , Genus:
ttgaattgtttgtttgaattggcttaaaaccccaattcagcatccatatccataacacctgtgcactgttggatgacctttgctcttcggagtgctggaagtccacttttacactaaacaatttgtaacaaatgtagtcttattataacaataataaaactttcaacaacggatctcttggttctc

SEQ ID NO: 1644 - DNA, 175 bp, Unknown
  Kingdom: Fungi, Phylum: Zygomycota, Class: Incertae sedis, Order: Mortierellales, Family: Mortierellaceae, Genus: Mortierella
taataagtgttttatggcactttttaaatccatatccaccttgtgtgcaatgtcagtcgatcttcttcatggaggtcgaccaaacatcaacctatttttttaactctttgtctgaaaaatattatgaataaaataattcaaaatacaactttcaacaacggatctcttggctctc

SEQ ID NO: 1645 - DNA, 202 bp, Unknown
  Kingdom: Fungi, Phylum: Zygomycota, Class: Incertae sedis, Order: Mortierellales, Family: Mortierellaceae, Genus:
taatcaagtgtttttatggcactttcaaaaatccatatccaccttgtgtgcaatgtcatctctctgggggctgccggctgtcaaaagccgtgtggtcacctttgggatttatatctactcagaactttagtgattttgtctgaaacatattatgaatacttaattcaaaatacaactttcaacaacggatctcttggctctc

SEQ ID NO: 1646 - DNA, 183 bp, Unknown
  Kingdom: Fungi, Phylum: Zygomycota, Class: Incertae sedis, Order: Mortierellales, Family: Mortierellaceae, Genus:
ggatcattcataataagtgttttatggcactttttaaatccatatccaccttgtgtgcaatgtcagtcgatcttcttcatggagatcgaccaaacatcaacctaagttttaactctttgtctgaaaaatattatgaataaacaattcaaaatacaactttcaacaacggatctcttggctctc

SEQ ID NO: 1647 - DNA, 182 bp, Unknown
  Kingdom: Fungi, Phylum: Zygomycota, Class: Incertae sedis, Order: Mortierellales, Family: Mortierellaceae, Genus:
ggatcattcataataagtgttttatggcactttttaaatccatatccaccttgtgtgcaatgtcagtcgatcttcatggagatcgaccaaacatcaacctttattttttaactctttgtctgaaaaatattatgaataaacaattcaaaatacaactttcaacaacggatctcttggctctc

SEQ ID NO: 1648 - DNA, 229 bp, Unknown
  Kingdom: Fungi, Phylum: Zygomycota, Class: Incertae sedis, Order: Mucorales, Family: Rhizopodaceae, Genus:
atcattaattatgttaaagcgccttaccttagggtttcytctggggtaagtgattgcttctacactgtgaaaatttggctgagagactcagactggtcatgggtagacctatctggggtttgatcgatgccactcctggtttcaggagtacccttcataataaacctagaaattcagtattataaagtttaataaaaaacaacttttaacaatggatctcttggttctc

SEQ ID NO: 1649 - DNA, 183 bp, Unknown
  Kingdom: Fungi, Phylum:  , Class:  , Order:  , Family:  , Genus:
gttggtgaaccagcggagggatcattacagagttatctaactcccaaacccatgtgaacttacctttgttgcctcggcagtttgggcgagcctaccctgtagctgcttaccctgtaacggctgccgacggactactaaactcttgttatttttaagtaatctgagcgtcttattttaataagt

SEQ ID NO: 1650 - DNA, 251 bp, Unknown
  Kingdom: Fungi, Phylum:  , Class:  , Order:  , Family:  , Genus:
gtaggtgaacctgcggaaggatcattcataataagtgttttatggcactttttaaatccatatccaccttgtgtgcaatgtcagtcgatcttcttcatggagatcgaccaaacatcaacctttattttttaactctttgtctgaaaaatattatgaataaacaattcaaaatacaactttcaacaacggatctcttggctctcgcatcgatgaagaacgcagcatctgactgacttaactctgatgcatct

SEQ ID NO: 1651 - DNA, 249 bp, Unknown
  Kingdom: Fungi, Phylum:  , Class:  , Order:  , Family:  , Genus:
gtaggtgaacctgcggaaggatcattactttcagtagcttgctactgtgtaagagggtctattagcctgtatagtattactactgatgagcagcatgaccctctgtctatacccttgtcttttgcgcactcatgtttcctcggcggcttacccccgccggtcggacaacttaataacctttttaatttttaatcagcgtctgaaaaacctaattatttacaactttcaacaacggatctcttggttctg

SEQ ID NO: 1652 - DNA, 183 bp, Unknown
  Kingdom: Fungi, Phylum:  , Class:  , Order:  , Family:  , Genus:
gttggtgaaccagcggagggatcattacgagagtgtcgccactcccaaccactgtttacctacccgtccaccgtgcctcggcaggcagccctgtgggacagagcctcgccccccgtttcggggggtgtctgccgctggccgacccaaattcagctgtatcgtaccttctgagtatctcacaaa

SEQ ID NO: 1653 - DNA, 252 bp, Unknown
  Kingdom: Fungi, Phylum:  , Class:  , Order:  , Family:  , Genus:
gtaggtgaacctgcggaaggatcattacaatcagtagatttctactgctgagagagagcggaaagtagtcagctgcccctggtagtctggctacaagtacgttctctgtctgtacccttgtctttttgcgcactcatgtttcctcggcgggcttgctcgccggttggacaatcctaaaacctttttaattttcaatcagcgtctgaataattataataattacaactttcaacaacggatctcttggttctg

SEQ ID NO: 1654 - DNA, 251 bp, Unknown
  Kingdom: Fungi, Phylum:  , Class:  , Order:  , Family:  , Genus:
gttggtgaaccagcggagggatcattacagagttgcaaaactcccaaccatcgtgaatctacctcaccgttgcttcggcgggtggctcgggcacaacccgggccgcgccggccccgcctcgcggggtccggcaacccgtcagaggaccgaaactcttagtcatcattggcctctctgagtaacttatacaataagtcaaaactttcaacaacggatctcttggttctggcatcgatgaagaacgcagcatc

SEQ ID NO: 1655 - DNA, 203 bp, Unknown
  Kingdom: Fungi, Phylum:  , Class:  , Order:  , Family:  , Genus:
cctgcggagggatcattacaagtgaccccggtctaaccaccgggatgttcataaccctttgttgtccgactctgttgcctccggggcgaccctgccttcgggcgggggctccgggtggacacttcaaactcttgcgtaactttgcagtctgagtaaacttaattaataaattaaaacttttaacaacggatctcttggttctg

SEQ ID NO: 1656 - DNA, 251 bp, Unknown
  Kingdom: Fungi, Phylum:  , Class:  , Order:  , Family:  , Genus:
gtaggtgaacctgcggaaggatcattacctagagttgcgggctttgcctgccatctcttacccatgtcttttgagtaccttcgtttcctcggtgggttcgcccgccgactggacaaaacttaaaccctttgtaattgaaatcagcgtctgaaaaaacttaatagttacaactttcaacaacggatctcttggttctggcatcgatgaagaacgcagcatctgactgactattcatggacgcatctcgtatg

SEQ ID NO: 1657 - DNA, 245 bp, Unknown
  Kingdom: Fungi, Phylum:  , Class:  , Order:  , Family:  , Genus:
gtaggtgaacctgcggaaggatcattaaatttcggtagtctactaccgtttgagggaggtagaaactgggcagctatagctgtgcagaagtatacttcttttctcaacccttgactttttgcgcacttgtgtttcctcggcaggcatgcctgccgattggacaaatcaataacctttttaattttcaatcagcgtctgaattattttaataattacaactttcaacaacggatctcttggttctg

SEQ ID NO: 1658 - DNA, 240 bp, Unknown
  Kingdom: Fungi, Phylum:  , Class:  , Order:  , Family:  , Genus:
gtaggtgaacctgcggaaggatcattaccgagtgcgggccctctgggtccaacctcccatccgtgtctcttgtaccctgttgcttcggcgggcccgccttcatggccgccggggggctctctagcccccgggcccgcgcccgccggagactccaacattgaacactgtctgaagtttgcagtctgagttttcataaaagaaaaatcgttaaaactttcaacaacggatctcttggttccg

SEQ ID NO: 1659 - DNA, 235 bp, Unknown
  Kingdom: Fungi, Phylum:  , Class:  , Order:  , Family:  , Genus:
aaggatcattatgaatcagtagcttgctactgcgctgggggagatgggaaagtcctggctgaaaagttagtgtaccggtacctgcacccctatcatacccttgtcttttaagcacttatgtttccttggtgggcttgcctgccgataggacaacttttaaaccttttaatatgtcaatcagcgtctgaaaaataattaataattacaactttcaacaacggatctcttggttctg

SEQ ID NO: 1660 - DNA, 183 bp, Unknown
  Kingdom: Fungi, Phylum:  , Class:  , Order:  , Family:  , Genus:
gtaggtgaacctgcggaaggatcattaccaaaagataatctttcaacattgaaagatcttacctttgtgctggctttgacagttttgtacttttggggctttaaaatggtttggtagttaaaggagggagcaatccctttttttcatgctactgggtcggccccaaataatcatatcatcctt

SEQ ID NO: 1661 - DNA, 289 bp, Unknown
  Kingdom: Fungi, Phylum:  , Class:  , Order:  , Family:  , Genus:
aagtcgtaacaaggtttccgtaggtgaacctgcggaaggatcattaaattcagtagcttgctactgttaggggggggtctattagtctgtatagtatcactactgatgagcagcacgaccctctgtctatacccttgtcttttgcgcactcatgtttcctcggcggcttaatatccgccggctggatcaatctataaccttttgaattttcaatcagcgtctgaaaaacctaataattacaactttcaacaacggatctcttggttctggcatcgatgaagaacgcagc

SEQ ID NO: 1662 - DNA, 183 bp, Unknown
  Kingdom: Fungi, Phylum:  , Class:  , Order:  , Family:  , Genus:
gttggtgaaccagcggagggatcattaccgagtttacaactcccaaacccatgtgaacatacctgtcttgttgcttcggcggcgcccacggccctcacgggcttggggcccgccagaggacccaaacaaaactctttgcattttgaatacagtattctgagtgacatgattaaataaaatcaa

SEQ ID NO: 1663 - DNA, 214 bp, Unknown
  Kingdom: Fungi, Phylum:  , Class:  , Order:  , Family:  , Genus:
gtaggtgaacctgcggaaggatcattaatgaataagaacacgtctcatggcgttcttggatcattgtacattcgtctttgatccagttctctcatatccataacacctgtgcactgttggatgcttgcatccacttttaaactaaacattattgtaacaaatgtagtcttattataacataataaaactttcaacaacggatctcttggctctc

SEQ ID NO: 1664 - DNA, 183 bp, Unknown
  Kingdom: Fungi, Phylum:  , Class:  , Order:  , Family:  , Genus:
gtaggtgaacctgcggaaggatcattcataatcaagtgtttttatggcactttcaaaaatccatatccaccttgtgtgcaatgtcatctcactgggggccaacgggtgtaaaaatccgtttggtcgcctttgggatttatatctactcagaactttagtgattttgtctgaaaacatattatg

SEQ ID NO: 1665 - DNA, 251 bp, Unknown
  Kingdom: Fungi, Phylum:  , Class:  , Order:  , Family:  , Genus:
gtaggtgaacctgcggaaggatcattacctagagttgtaggctttgcctgctatctcttacccatgtcttttaagtaccttcgtttcctcggcgggctcgcccgccgattggacaatttaaaccatttgcagttgcaatcagcgtctgaaaaaacttaatagttacaactttcaacaacggatctcttggttctggcatcgatgaagaacgcagcatctgactgacttggagcacgttgatatcgtatgcc

SEQ ID NO: 1666 - DNA, 251 bp, Unknown
  Kingdom: Fungi, Phylum:  , Class:  , Order:  , Family:  , Genus:
gtaggtgaacctgcggaaggatcattaccgagtgcgggcccctcggggcccaacctcccacccgtgttgcccgaacctatgttgcctcggcgggccccgcgcccgccgacggcccccctgaacgctgtctgaagttgcagtctgagacctataacgaaattagttaaaactttcaacaacggatctcttggttccggcatcgatgaagaacgcagcatctgactgactttcgttgtggtaatctcgtatgc

SEQ ID NO: 1667 - DNA, 183 bp, Unknown
  Kingdom: Fungi, Phylum:  , Class:  , Order:  , Family:  , Genus:
gtaggtgaacctgcggaaggatcattattgaattataaggctccgattgtgctggcctctcggggcatgtgcacgtctctgcccgttaatcccaacccacccctgtgaaccgaccgtgtgaggcgctctgtaatggagctgtctcatgctttatcataaaccctgtatgtcatcagaatgtaa

SEQ ID NO: 1668 - DNA, 222 bp, Unknown
  Kingdom: Fungi, Phylum:  , Class:  , Order:  , Family:  , Genus:
gtaggtgaacctgcggagggatcattacacaataacaaggcgggctggctctctcccgggaggactggccctgctgaattattcacccgtgtcttttgcgtacttcttgtttcctgggcgggctcgcccgccaccaggaccccccataaaccttttgcaatggcaatcagcgtcagtaaaatataatcattacaactttcaacaacggatctcttggttctg

SEQ ID NO: 1669 - DNA, 249 bp, Unknown
  Kingdom: Fungi, Phylum:  , Class:  , Order:  , Family:  , Genus:
gtaggtgaacctgcggaaggatcattacaattcttgggcgtgcccatgtcgggaggcgctgtaagcccgcatagtttaaatgcactgaagagcggcaggcgcttctgtctgaacccttgtcctttgcgcacctttgtttccgcggcgggttcgcccgccggctggactacactataacctttttaattttcaatcagcgtctgaaaaaacaaataattacaactttcaacaacggatctcttggttctg

SEQ ID NO: 1670 - DNA, 183 bp, Unknown
  Kingdom: Fungi, Phylum:  , Class:  , Order:  , Family:  , Genus:
gtaggtgaacctgcggaaggatcattaccgagagttgtaggcttctgtctaccatctcttacccatgtcttttgcgtacttaacgtttcctcggcaggtccgcctgccgtaggacaattataaaccatttgcagttgcagtcagcgtctgaaaaacataataattacaacttttaacaacgga

SEQ ID NO: 1671 - DNA, 251 bp, Unknown
  Kingdom: Fungi, Phylum:  , Class:  , Order:  , Family:  , Genus:
gtaggtgaacctgcggaaggatcattagtgaatctaggacgtccaacttaacttggagtccgaactctcactttctaaccctgtgcatctgttaattggaatagtagctcttcggagtgaaccaccattcacttataaaacacaaagtctatgaatgtatacaaatttataacaaaacaaaactttcaacaacggatctcttggctctcgcatcgatgaagaacgcagcatctgactgactcgcaaattcg

SEQ ID NO: 1672 - DNA, 185 bp, Unknown
  Kingdom: Fungi, Phylum:  , Class:  , Order:  , Family:  , Genus:
caagtgaccccggtctaaccaccgggatgttcataaccctttgttgtccgactctgttgcctccggggcgaccctgccttcgggcgggggctccgggtggacacttcaaactcttgcgtaactttgcagtctgagtaaacttaattaataaattaaaacttttaacaacggatctcttggttctg

SEQ ID NO: 1673 - DNA, 251 bp, Unknown
  Kingdom: Fungi, Phylum:  , Class:  , Order:  , Family:  , Genus:
gtaggtgaacctgcggaaggatcattataaaaaattcgggcttgggtttaacccaagacctgcccccaaaagggaccttttgtgcactgtaaaattttttcacttaagctttgtctgattgatatttgtaccgaaagggacaagaattttaatctaaaacaacttttaacaatggatctcttggctctcgcatcgatgaagaacgcagcatctgactgacttggaagatgagtatctcgtatgccgtcttc

SEQ ID NO: 1674 - DNA, 246 bp, Unknown
  Kingdom: Fungi, Phylum:  , Class:  , Order:  , Family:  , Genus:
gtaggtgaacctgcggagggatcattacacaataaaatatgaaggctgtacgcggctgtgctctcgggccagttttgcggaggctgaattatttattacccttgtcttttgcgcacttgttgtttcctgggcgggttcgcccgccaccaggaccacatcataaaccttttttatgcagttgcaatcagcgtcagtataacaaatgtaaatcatttacaactttcaacaacggatctcttggttctg

SEQ ID NO: 1675 - DNA, 249 bp, Unknown
  Kingdom: Fungi, Phylum:  , Class:  , Order:  , Family:  , Genus:
gtaggtgaacctgcggaaggatcattacattcagtagcttgctactgttagggaggccggttagtctgtatagtatcactactaataagcagcacagccttctgtctgtacccttgtcttttgcgcactcatgtttcctcggctgggtttacgcccgccagttagacaactctataacctttttaattttcaatcagcgtctgaaaaacctaataattacaactttcaacaacggatctcttggttcta

SEQ ID NO: 1676 - DNA, 235 bp, Unknown
  Kingdom: Fungi, Phylum:  , Class:  , Order:  , Family:  , Genus:
tctattccatgaggtgcggtcgcggccctcggcgggagcaacagctaccgtcgggcggtagaggtaacactttcacgcgccgcatgtctgaatcctttttttacgagcacctttcgttctccttcggcggggcaacctgccgttggaacctatcaaaacctttttttgcatctagcattacctgttctgatacaaacaatcgttacaactttcaacaatggatctcttggctctg

SEQ ID NO: 1677 - DNA, 234 bp, Unknown
  Kingdom: Fungi, Phylum:  , Class:  , Order:  , Family:  , Genus:
aagtcgtaacaaggtttccgtaggtgaacctgcggaaggatcattacctagagttgtaggctttgcctgctatctcttacccatgtcttttgagtacttacgtttcctcggcgggtccgcccgccgattggacaatttaaaccatttgcagttgcaatcagcgtctgaaaaactttaatagttacaactttcaacaacggatctcttggttctggcatcgatgaagaacgcagc

SEQ ID NO: 1678 - DNA, 183 bp, Unknown
  Kingdom: Fungi, Phylum:  , Class:  , Order:  , Family:  , Genus:
gtaggtgaacctgcggaaggatcattagattgaattatcattgttgctcgagttcttgtttagatcttttacaataatgtgtatctttattggagatgtgcgcttaattgcgctgcttcattagagtgtcgcagtagaagtagtcttgcttgaatctcagtcaacgtttacacacattggagt

SEQ ID NO: 1679 - DNA, 251 bp, Unknown
  Kingdom: Fungi, Phylum:  , Class:  , Order:  , Family:  , Genus:
gtaggtgaacctgcggaaggatcattagtgaatattagggtgtccaacttaacttggagcccgaccctcactttctaaccctgtgcatttgtcttgggtagtagcttgcgtcagcgagcgaatcccatttcacttacaaacacaaagtctatgaatgtaacaaatttataacaaaacaaaactttcaacaacggatctcttggctctcgcatcgatgaagaacgcagcatctgactgactcgtaaccaacc

SEQ ID NO: 1680 - DNA, 225 bp, Unknown
  Kingdom: Fungi, Phylum:  , Class:  , Order:  , Family:  , Genus:
actgagtgagggcccctcggggtccaacctcccacccgtgtttaacgaaccttgttgcttcggcgggcccgcctcacggccgccggggggcatttgcccccgggcccgcgcccgccgaagccacctgtgaacgctgtctgaagtatgcagtctgagacaattattaaattaattaaaactttcaacaacggatctcttggttccggcatcgatgaagaacgcagc

SEQ ID NO: 1681 - DNA, 251 bp, Unknown
  Kingdom: Fungi, Phylum:  , Class:  , Order:  , Family:  , Genus:
gtaggtgaacctgcggaaggatcattacctagagttgtaggctttgcctgctatctcttacccatgtcttttgagtaccttacgtttcctcggtgggttcgcccaccgattggacaaacttaaaccctttgcagttgaaatcagcgtctgaaaaaacttaatagttacaactttcaacaacggatctcttggttctggcatcgatgaagaacgcagcatctgactgactggtaggaacaatatctcgtatg

SEQ ID NO: 1682 - DNA, 251 bp, Unknown
  Kingdom: Fungi, Phylum:  , Class:  , Order:  , Family:  , Genus:
gtaggtgaacctgcggaaggatcattacctagagttgtaggctttgcctgctatctcttacccatgtcttttgagtaccttacgtttcctcggtgggttcgcccaccgattggacaaatttaaaccctttgcagttgaaatcagcgtctgaaaaaacttaatagttacaactttcaacaacggatctcttggttctggcatcgatgaagaacgcagcatctgactgactcaagacacgaccatctcgtatg

SEQ ID NO: 1683 - DNA, 251 bp, Unknown
  Kingdom: Fungi, Phylum:  , Class:  , Order:  , Family:  , Genus:
gttggtgaaccagcggagggatcattacagagttattctaaactccaaaaccctatgtgaacttaccactgttgccttggcgtatgccgcgggctaccctgtagcgacctacccgggagctaccctgtagtacgcgtacggcccgccaaaggaccactaaactctttgtttttactgtgaatatctgaatgcttcgaaacttaataagttaaaactttcaacaacggatctcttggttctggcatcgatga

SEQ ID NO: 1684 - DNA, 233 bp, Unknown
  Kingdom: Fungi, Phylum:  , Class:  , Order:  , Family:  , Genus:
aagtcgtaacaaggtttccgtaggtgaacctgcggaaggatcattaatgaatttagattgaaccataggcgaaagccagtggttcttctttcatatccataacacctgtgcactgttggatgcttgcatccacttttaaactaaacattattgtaacaaatgtagtcttattataacataataaaactttcaacaacggatctcttggctctcgcatcgatgaagaacgcagc

SEQ ID NO: 1685 - DNA, 247 bp, Unknown
  Kingdom: Fungi, Phylum:  , Class:  , Order:  , Family:  , Genus:
gtaggtgaacctgcggaaggatcattacacttagtagatctctactactcaggggagaggggaaagtttttagcttagcggctgggaacgagtacgctctctatctgaacccttgtctttttgcgtactcatgtttcctcggtaggcctgcctgccggctggacaacttaataacctttttaattttcaatcagcgtctgaataattataataattacaactttcaacaacggatctcttggttctg

SEQ ID NO: 1686 - DNA, 217 bp, Unknown
  Kingdom: Fungi, Phylum:  , Class:  , Order:  , Family:  , Genus:
gtaggtgaacctgcggaaggatcattatagtgttcgctgccctcacgggtagcaaacctcacccttgtatatcatatctttgttgctttggcacgccacccccgggtgccggctccggctggctagtgcgtgtcgagggaccgtaaactctgaatgttggtgtcgtctgagtactatctaatagttaaaactttcaacaacggatctcttggttctg

SEQ ID NO: 1687 - DNA, 230 bp, Unknown
  Kingdom: Fungi, Phylum:  , Class:  , Order:  , Family:  , Genus:
gtaggtgaacctgcggaaggatcattagtgaattcaaatttcttccttcggggagtgcagcatgggccctcgtgcccatgttgtggaatcacatccttaacacctgtgaactgtctgtcaagaacaaggcttcggctttggacttgtacactttaccaaactttactctgtaaaaaatgtcatcttattataacttaataaaacttttaacaacggatctcttggctctc

SEQ ID NO: 1688 - DNA, 259 bp, Unknown
  Kingdom: Fungi, Phylum:  , Class:  , Order:  , Family:  , Genus:
gtaggtgaacctgcggaaggatcattaccgagtgcgggccctctgggtccaacctcccatccgtgtctattcataccctgttgcttcggcgggcccgctggctgccccctcctggggggcgccggccgccggggggctaccctgcccccgggcccgtgcccgccggggacaccaacactgaacactgtctgaaggttgcagtctgagttttcataaagaaaaattgttaaaactttcaacaacggatctcttggttccg

SEQ ID NO: 1689 - DNA, 215 bp, Unknown
  Kingdom: Fungi, Phylum:  , Class:  , Order:  , Family:  , Genus:
gttggtgaaccagcggagggatcattaccgagtttacaactcccaaacccctgtgaaccatacctgtcgttgcttcggcggccacgccccggtgccctcatgcccggaaccaggcgcccgccggaggccaaaaaaaccatgtttaccacagtggcattatctgagtggcacaagcaaataaatcaaaactttcaacaacggatctcttggttctg

SEQ ID NO: 1690 - DNA, 172 bp, Unknown
  Kingdom: Fungi, Phylum:  , Class:  , Order:  , Family:  , Genus:
cctagagtttgtagacttcggtctgctacctcttacccatgtcttttgagtaccttcgtttcctcggcgggtccgcccgccgattggacaacattcaaaccctttgcagttgcaatcagcgtctgaaaaaacataatagttacaactttcaacaacggatctcttggttctg

SEQ ID NO: 1691 - DNA, 183 bp, Unknown
  Kingdom: Fungi, Phylum:  , Class:  , Order:  , Family:  , Genus:
gttggtgaaccagcggagggatcattacagagtttacaactcccaaacccttctgtgaacataccaagatgttgcttcggcggactcgccccggcgtccggacggcccagcgccgcccgcggcccggactcaggcggccgccggagaccaccaaactcttttgtatcatgagtatcttctgaa

SEQ ID NO: 1692 - DNA, 245 bp, Unknown
  Kingdom: Fungi, Phylum:  , Class:  , Order:  , Family:  , Genus:
gtaggtgaacctgcggaaggatcattaatgaatgaatgtagagttggttgtagctggcttccctgaggcatgtgcacaccttctctttcatccacacacccctgtgcacttgtgagacggaggcgttttcctttaaccgggatggtctccgtctactatcacataaaatctaacttatttaaaactgaatgtaattgatgtaacgcatctaatacaaagtttcaacaacggatctcttggctctc

SEQ ID NO: 1693 - DNA, 204 bp, Unknown
  Kingdom: Fungi, Phylum:  , Class:  , Order:  , Family:  , Genus:
gtaggtgaacctgcggaaggatcactaaagtaaacgccctccggggctctctttaattcacacacccctgtgcactttggccacctgccgcgctttactgcgttagtaggtgtgtctttttaactatacactatatacacaagtcattgaatgtaaaatagttataaactaatataactttcaacaacggatctcttggttctc

SEQ ID NO: 1694 - DNA, 213 bp, Unknown
  Kingdom: Fungi, Phylum:  , Class:  , Order:  , Family:  , Genus:
gtaggtgaacctgcggagggatcattataagttcacccaggcttgtacagctggggactgacaaccctttgatttccgactctgttgcctccggggcgaccctgccttcgggcgggggctccgggtggacacttcaaactcttgcgtaactttgcagtctgagtaaacttaattaataaattaaaacttttaacaacggatctcttggttctg

SEQ ID NO: 1695 - DNA, 1472 bp, Unknown
  Kingdom: Bacteria, Phylum: Proteobacteria, Class: Gammaproteobacteria, Order: Enterobacteriales, Family: Enterobacteriaceae, Genus: Pantoea
gctcagattgaacgctggcggcaggcctaacacatgcaagtcgaacggcagcacagaagagcttgctctttgggtggcgagtggcggacgggtgagtaatgtctgggaaactgcccgatggagggggataactactggaaacggtagctaataccgcataacgtcgcaagaccaaagtgggggaccttcgggcctcacaccatcggatgtgcccagatgggattagctagtaggtggggtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcggtgaggttaataaccttgccgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaa

SEQ ID NO: 1696 - DNA, 1474 bp, Unknown
  Kingdom: Bacteria, Phylum: Proteobacteria, Class: Gammaproteobacteria, Order: Enterobacteriales, Family: Enterobacteriaceae, Genus: Pantoea
tggctcagattgaacgctggcggcaggcctaacacatgcaagtcggacggtagcacagaggagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcagtgaggttaataaccttactgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaacctccgggagggcgcttaccactttgtgattcatgactggggtgaa

SEQ ID NO: 1697 - DNA, 1478 bp, Unknown
  Kingdom: Bacteria, Phylum: Proteobacteria, Class: Gammaproteobacteria, Order: Enterobacteriales, Family: Enterobacteriaceae, Genus: Pantoea
atggctcagattgaacgctggcggcaggcctaacacatgcaagtcggacggtagcacagaggagcttgctcctcgggtgacgagtggcggacgggtgagtaatgtctggggatctgcccgatagagggggataaccactggaaacggtggctaataccgcataacgtcgcaagaccaaagagggggaccttcgggcctctcactatcggatgaacccagatgggattagctagtaggcggggtaacggcccacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgataaggttaataaccttgtcgattgacgttacccgcagaagaagcaccggctaactccgtgccagcagccgcggtaatacggagggtgcaagcgttaatcggaattactgggcgtaaagcgcacgcaggcggtctgttaagtcagatgtgaaatccccgggcttaacctgggaactgcatttgaaactggcaggcttgagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggttgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacgagtagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaacctccgggagggcgcttaccactttgtgattcatgactggggtgaagtc

SEQ ID NO: 1698 - DNA, 1473 bp, Unknown
  Kingdom: Bacteria, Phylum: Proteobacteria, Class: Gammaproteobacteria, Order: Enterobacteriales, Family: Enterobacteriaceae, Genus: Citrobacter
tggctcagattgaacgctggcggcaggcctaacacatgcaagtcgaacggtaacaggaagcagcttgctgcttcgctgacgagtggcggacgggtgagtaatgtctgggaaactgcctgatggagggggataactactggaaacggtagctaataccgcataatgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgataaggttaataaccttgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtga

SEQ ID NO: 1699 - DNA, 1473 bp, Unknown
  Kingdom: Bacteria, Phylum: Proteobacteria, Class: Gammaproteobacteria, Order: Enterobacteriales, Family: Enterobacteriaceae, Genus: Citrobacter
gctcagattgaacgctggcggcaggcctaacacatgcaagtcgagcggtagcacagagagcttgctctcgggtgacgagtggcggacgggtgagtaatgtctgggaaactgcctgatggagggggataactactggaaacggtagctaataccgcataacgtcgcaagaccaaagagggggaccttcgggcctcttgccatcagatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgataaggttaataaccttgtcgattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaacttagcagagatgctttggtgccttcgggaactctgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtagatcagaatgctacggtgaatacgttcccgggccttgtacacaccgcccgtcacaccatgggagtgggttgcaaaagaagtaggtagcttaaccttcgggagggcgcttaccactttgtgattcatgactggggtgaagtc

SEQ ID NO: 1700 - DNA, 1476 bp, Unknown
  Kingdom: Bacteria, Phylum: Proteobacteria, Class: Gammaproteobacteria, Order: Enterobacteriales, Family: Enterobacteriaceae, Genus: Citrobacter
ggctcagattgaacgctggcggcaggcctaacacatgcaagtcgaacggtaacaggaagcagcttgctgctttgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgaggttaataacctcagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtc

SEQ ID NO: 1701 - DNA, 1487 bp, Unknown
  Kingdom: Bacteria, Phylum: Proteobacteria, Class: Gammaproteobacteria, Order: Enterobacteriales, Family: Enterobacteriaceae, Genus: Citrobacter
gctcagattgaacgctggcggcaggcctaacacatgcaagtcgaacggtagcacaggggagcttgctccccgggtgacgagtggcggacgggtgagtaatgtctgggaaactgcccgatggagggggataactactggaaacggtagctaataccgcataacgtcttcggaccaaagtgggggaccttcgggcctcacgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcgatgcggttaataaccgcgtcgattgacgttacccgcagaagaagcaccggctaactccgtgccagcagccgcggtaatacggagggtgcaagcgttaatcggaattactgggcgtaaagcgcacgcaggcggtctgtcaagtcagatgtgaaatccccgggcttaacctgggaactgcatttgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggctgttcccttgaggagtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccacggaattcggcagagatgccttagtgccttcgggaaccgtgagacaggtgctgcatggctgtcgtcagctcgtgttgtgaaatgttgggttaagtcccgcaacgagcgcaacccttatcctttgttgccagcgattcggtcgggaactcaaaggagactgccggtgataaaccggaggaaggtggggatgacgtcaagtcatcatggcccttacggccagggctacacacgtgctacaatggcgcatacaaagagaagcgaactcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtcgtaccaaaggta

SEQ ID NO: 1702 - DNA, 1474 bp, Unknown
  Kingdom: Bacteria, Phylum: Proteobacteria, Class: Gammaproteobacteria, Order: Enterobacteriales, Family: Enterobacteriaceae, Genus: Citrobacter
ctcagattgaacgctggcggcaggcctaacacatgcaagtcgaacggtaacaggaagcagcttgctgctttgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggtgttgaggttaataacctcagcaattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacctgggaactgcattcgaaactggcaggctagagtcttgtagaggggggtagaattccaggtgtagcggtgaaatgcgtagagatctggaggaataccggtggcgaaggcggccccctggacaaagactgacgctcaggtgcgaaagcgtggggagcaaacaggattagataccctggtagtccacgccgtaaacgatgtcgacttggaggttgtgcccttgaggcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctactcttgacatccagagaactttccagagatggattggtgccttcgggaactctgagacaggtgctgcatggctgtcgtcagctcgtgttgtgaaatgttgggttaagtcccgcaacgagcgcaacccttatcctttgttgccagcggttaggccgggaactcaaaggagactgccagtgataaactggaggaaggtggggatgacgtcaagtcatcatggcccttacgagtagggctacacacgtgctacaatggcgcatacaaagagaagcgacctcgcgagagcaagcggacctcataaagtgcgtcgtagtccggattggagtctgcaactcgactccatgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgcttaccactttgtgattcatgactggggtgaagtc

SEQ ID NO: 1703 - DNA, 1466 bp, Unknown
  Kingdom: Bacteria, Phylum: Proteobacteria, Class: Gammaproteobacteria, Order: Enterobacteriales, Family: Enterobacteriaceae, Genus: Citrobacter
tggctcagattgaacgctggcggcaggcctaacacatgcaagtcgaacggtaacagagagcagcttgctgctctgctgacgagtggcggacgggtgagtaatgtctggggatctgcccgatggagggggataaccactggaaacggtggctaataccgcataacgtcgcaagaccaaagtgggggaccttcgggcctcacaccatcggatgaacccagatgggattagctagtaggtggggtaacggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaagggagtgaggctaataaccttattcattgacgttacccgcagaagaagcaccggctaactccgtgccagcagccgcggtaatacggagggtgcaagcgttaatcggaattactgggcgtaaagcgcacgcaggcggtctgtcaagtcggatgtgaaatccccgggctcaacccgggaactgcattcgaaactggcaggctagagtctcgtagaggggggtagaattccaggtgtagcggtgaaatgcgtagagatctggaggaataccggtggcgaaggcggccccctggacgaagactgacgctcaggtgcgaaagcgtggggagcaaacaggattagataccctggtagtccacgccgtaaacgatgtcgacttggaggctgtgagcttgactcgtggcttccggagctaacgcgttaagtcgaccgcctggggagtacggccgcaaggttaaaactcaaatgaattgacgggggcccgcacaagcggtggagcatgtggtttaattcgatgcaacgcgaagaaccttacctggccttgacatccacggaattctgcagagatgcggaagtgccttcgggaaccgtgagacaggtgctgcatggctgtcgtcagctcgtgttgtgaaatgttgggttaagtcccgcaacgagcgcaacccttatcctttgttgccagcggctcggccgggaactcaaaggagactgccggtgataaaccggaggaaggtggggatgacgtcaagtcatcatggcccttacggccagggctacacacgtgctacaatggcgcatacaaagagaagcgacctcgcgagagcaagcggacctcataaagtgcgtcgtagtccggatcggagtctgcaactcgactccgtgaagtcggaatcgctagtaatcgtggatcagaatgccacggtgaatacgttcccgggccttgtacacaccgcccgtcacaccatgggagtgggttgcaaaagaagtaggtagcttaaccttcgggagggcgctaccactttgtgattcatgactg

SEQ ID NO: 1704 - DNA, 20 bp, Artificial Sequence
  16S Primer Sequence, 27f
agagtttgatymtggctcag

SEQ ID NO: 1705 - DNA, 19 bp, Artificial Sequence
  16S Primer Sequence, 1492r
ggttaccttgttacgactt

SEQ ID NO: 1706 - DNA, 19 bp, Artificial Sequence
  16S Primer Sequence, 515f
gtgycagcmgccgcggtaa

SEQ ID NO: 1707 - DNA, 20 bp, Artificial Sequence
  16S Primer Sequence, 806r
  misc_feature (8)..(8): n is a, c, g, or t
ggactacnvgggtwtctaat

SEQ ID NO: 1708 - DNA, 22 bp, Artificial Sequence
  ITS Primer Sequence, ITS_1
cttggtcatttagaggaagtaa

SEQ ID NO: 1709 - DNA, 20 bp, Artificial Sequence
  ITS Primer Sequence, ITS_2
gctgcgttcttcatcgatgc

SEQ ID NO: 1710 - DNA, 20 bp, Artificial Sequence
  ITS Primer Sequence, ITS_3
gcatcgatgaagaacgcagc

SEQ ID NO: 1711 - DNA, 17 bp, Artificial Sequence
  ITS Primer Sequence, LR5
tcctgagggaaacttcg

What is claimed is:

1. A method of preparing a synthetic combination, comprising inoculating a plurality of plant elements of plants with a formulation comprising at least a first and a second endophyte population heterologously disposed to the plant elements, wherein the first endophyte comprises a first nucleic acid sequence having at least 98% identity to a nucleic acid sequence of SEQ ID NO: 1098 and the second endophyte comprises a second nucleic acid sequence having 100% identity to a nucleic acid sequence of SEQ ID NO: 1106, wherein the endophyte populations are present in the formulation in an amount capable of:

(a) modulating a trait of agronomic importance in plants comprising or derived from said plant elements, as compared to reference isoline plants not comprising or not derived from plant elements inoculated with said formulation; and/or (b) improving a plant phenotype under stress conditions as compared to reference isoline plants not comprising or not derived from plant elements inoculated with said formulation.

2. The method of claim 1, wherein the improved plant phenotype is selected from the group consisting of: increased germination rate, increased disease resistance, increased heat tolerance, increased drought tolerance, increased water use efficiency, increased cold tolerance, increased salinity tolerance, increased metal tolerance, increased herbicide tolerance, increased chemical tolerance, increased nitrogen utilization, increased nitrogen use efficiency, resistance to nitrogen stress, increased tolerance to low nitrogen stress, improved nitrogen fixation, increased pest resistance, increased herbivore resistance, increased pathogen resistance, increased insect resistance, increased yield, increased yield under water-limited conditions, increased grain or fruit mass, kernel moisture content, increased number of ears, increased number of kernels per ear, health enhancement, increased vigor improvement, growth improvement, photosynthetic capability improvement, nutrition enhancement, altered protein content, altered oil content, increased biomass, increased root biomass, increased root length, increased root surface area, improved root architecture, increased shoot length, increased shoot height, increased shoot biomass, increased seed weight, altered seed carbohydrate composition, altered seed oil composition, increased number of pods, delayed senescence, stay-green, altered seed protein composition, increased dry weight of mature seeds, increased fresh weight of mature seeds, increased number of mature seeds per plant, increased number of flowers per plant, increased chlorophyll content, increased photosynthesis rate, increased number of leaves, increased number of pods per plant, increased length of pods per plant, reduced number of wilted leaves per plant, reduced number of severely wilted leaves per plant, increased number of non-wilted leaves per plant, increased resistance to a fungal pathogen, increased resistance to a bacterial pathogen, increased resistance to a viral pathogen, increased resistance to a nematode, a detectable modulation in the level of a metabolite, a detectable modulation in gene expression, and a detectable modulation in the proteome.

3. The method of claim 1, wherein the formulation comprises the endophyte population at a concentration of at least about $10^2$ CFU/ml or spores/ml in a liquid formulation or about $10^2$ CFU/gm or spores/ml in a non-liquid formulation.

4. The method claim 1, wherein the trait of agronomic importance is selected from the group consisting of: disease resistance, heat tolerance, drought tolerance, water use efficiency, cold tolerance, salinity tolerance, metal tolerance, herbicide tolerance, chemical tolerance, nitrogen utilization, nutrient utilization, resistance to nitrogen stress, nitrogen fixation, pathogen resistance, insect resistance, yield, yield under water-limited conditions, grain weight, fruit weight, kernel moisture content, number of ears, number of kernels per ear, health enhancement, vigor, growth, photosynthetic capability, nutrition enhancement, altered protein content, altered oil content, biomass, root biomass, root length, root surface area, root architecture, shoot length, shoot height, shoot biomass, seed weight, seed carbohydrate composition, seed oil composition, number of pods, delayed senescence, stay-green, seed protein composition, dry weight of mature seeds, fresh weight of mature seeds, number of mature seeds per plant, number of flowers per plant, chlorophyll content, rate of photosynthesis, number of leaves, number of pods per plant, length of pods per plant, number of wilted leaves per plant, number of severely wilted leaves per plant, number of non-wilted leaves per plant, resistance to a fungal pathogen, resistance to a bacterial pathogen, resistance to a viral pathogen, resistance to a nematode, a detectable modulation in the level of a metabolite, a detectable modulation in gene expression, and a detectable modulation in the proteome.

5. The method of claim 1, wherein the plurality of plant elements are seeds, and the seeds are modified seeds.

6. The method of claim 1, wherein plants comprising or derived from the plant elements are monocots, wherein the monocots are selected from the group consisting of a maize plant, a rice plant, a wheat plant, a barley plant, a sorghum plant, and a sugarcane plant.

7. The method of claim 1, wherein plants comprising or derived from the plant elements are dicots, wherein the dicots are selected from the group consisting of a cotton plant, a soybean plant, a pepper plant, a rapeseed plant, a canola plant, and a tomato plant.

8. A synthetic combination comprising a treatment formulation and a plant element of a plant comprising at least a first and a second endophyte population heterologously disposed to the plant element, wherein the first endophyte comprises a first nucleic acid sequence having at least 98% identity to a nucleic acid sequence of SEQ ID NO: 1098 and the second endophyte comprises a second nucleic acid sequence having 100% identity to a nucleic acid sequence of SEQ ID NO: 1106, wherein the endophyte populations are present in an effective amount capable of modulating a trait of agronomic importance in a plant comprising or derived from said synthetic combination, as compared to a reference isoline plant not comprising or not derived from the synthetic combination, and wherein the treatment formulation comprises an agriculturally compatible carrier, a tackifier, a microbial stabilizer, a fungicide, an antibacterial agent, an herbicide, a nematicide, an insecticide, a plant growth regulator, or a rodenticide.

9. The synthetic combination of claim 8, wherein the first and second endophytes are localized on the surface of the plant element.

10. The synthetic combination of claim 8, wherein at least one of the first endophyte and the second endophyte is obtained from:
(a) a plant species other than the plant elements of the synthetic combination;
(b) a plant cultivar different from the cultivar of the plant elements of the synthetic combination; or
(c) a plant cultivar that is the same as the cultivar of the plant elements of the synthetic combination.

11. The synthetic combination of claim 8, wherein the first endophyte comprises a nucleic acid sequence having 100% identity to SEQ ID NO: 1098.

12. The synthetic combination of claim 8, wherein the trait of agronomic importance is selected from the group consisting of: disease resistance, heat tolerance, drought tolerance, water use efficiency, cold tolerance, salinity tolerance, metal tolerance, herbicide tolerance, chemical tolerance, improved nitrogen utilization, improved nitrogen use efficiency, resistance to nitrogen stress, increased tolerance to low nitrogen stress, improved nitrogen fixation, pest resistance, herbivore resistance, pathogen resistance, increased yield, health enhancement, vigor improvement, growth improvement, photosynthetic capability improvement, nutrition enhancement, altered protein content, altered oil content, increased biomass, increased root biomass, increased root length, increased root surface area, improved root architecture, increased shoot length, increased shoot height, increased shoot biomass, increased seed weight, altered seed carbohydrate composition, altered seed oil composition, increased number of pods, delayed senescence, stay-green, altered seed protein composition, increased dry weight of mature seeds, increased fresh weight of mature seeds, increased number of mature seeds per plant, increased chlorophyll content, increased photosynthesis rate, increased number of leaves, increased number of pods per plant, increased length of pods per plant, reduced number of wilted leaves per plant, reduced number of severely wilted leaves per plant, increased number of non-wilted leaves per plant, increased resistance to a fungal pathogen, increased resistance to a bacterial pathogen, increased resistance to a viral pathogen, increased resistance to a nematode, a detectable modulation in the level of a metabolite, a detectable modulation in gene expression, and a detectable modulation in the proteome.

13. The synthetic combination of claim 8, wherein the plant element is a seed and the first and second endophytes are heterologously disposed as a coating on the surface of the seed; or the plant element is a seedling and the first and second endophytes are heterologously disposed as a spray applied to one or more leaves of the seedling or heterologously disposed as a drip applied to soil of the seedling.

14. The synthetic combination claim 8, wherein the effective amount is from about $1 \times 10^2$ CFU or spores/per plant element to about $1 \times 10^8$ CFU or spores/per plant element.

15. The synthetic combination of claim 8, wherein the plant comprising or derived from the plant element is modified.

16. The synthetic combination of claim 8, wherein the plant comprising or derived from the plant element is
   (a) a monocot, wherein the monocot is selected from the group consisting of: a maize plant, a rice plant, a wheat plant, a barley plant, a sorghum plant, and a sugarcane plant; or
   (b) a dicot, wherein the dicot is selected from the group consisting of: a cotton plant, a soybean plant, a pepper plant, a rapeseed plant, a canola plant, and a tomato plant.

17. A plant grown from the synthetic combination of claim 8, the plant exhibiting an improved phenotype selected from the group consisting of: increased germination rate, increased disease resistance, increased heat tolerance, increased drought tolerance, increased water use efficiency, increased cold tolerance, increased salinity tolerance, increased metal tolerance, increased herbicide tolerance, increased chemical tolerance, increased nitrogen utilization, increased nitrogen use efficiency, resistance to nitrogen stress, increased tolerance to low nitrogen stress, improved nitrogen fixation, increased pest resistance, increased herbivore resistance, increased pathogen resistance, increased insect resistance, increased yield, increased yield under water-limited conditions, increased grain or fruit mass, kernel moisture content, increased number of ears, increased number of kernels per ear, health enhancement, increased vigor improvement, growth improvement, photosynthetic capability improvement, nutrition enhancement, altered protein content, altered oil content, increased biomass, increased root biomass, increased root length, increased root surface area, improved root architecture, increased shoot length, increased shoot height, increased shoot biomass, increased seed weight, altered seed carbohydrate composition, altered seed oil composition, increased number of pods, delayed senescence, stay-green, altered seed protein composition, increased dry weight of mature seeds, increased fresh weight of mature seeds, increased number of mature seeds per plant, increased chlorophyll content, increased photosynthesis rate, increased number of leaves, increased number of pods per plant, increased length of pods per plant, reduced number of wilted leaves per plant, reduced number of severely wilted leaves per plant, increased number of non-wilted leaves per plant, increased resistance to a fungal pathogen, increased resistance to a bacterial pathogen, increased resistance to a viral pathogen, increased resistance to a nematode, a detectable modulation in the level of a metabolite, a detectable modulation in gene expression, and a detectable modulation in the proteome.

18. The method of claim 1, wherein
   endophyte comprises a nucleic acid sequence having 100% identity to SEQ ID NO: 1098.

19. The synthetic combination claim 8, wherein the plant element is a seed.

* * * * *